United States Patent 7,745,391 (HUMAN THROMBOSPONDIN POLYPEPTIDE) - sequence listing, part 197

SEQ ID NO: 465600 - DNA, 1841 bp, Homo sapiens
atattggtcaaggggtatgaagtttcagttatgctaagtgaacatgctttggaaacctaaggggcagggaggaggccagggaccaaggcactcaagtggggactgcaggaggggtcagaatgcaagcagcactgacggccttcttcgtgttgctctttagcctgctgagtcttctggggattgcagcgaatggcttcattgtgctggtgctgggcagggagtggctgcgatatggcaggttgctgcccttggatatgatcctcattagcttgggtgcctcccgcttctgcctgcagttggttgggacggtgcacaacttctactactctgcccagaaggtcgagtactctgggggtctcggccgacagttcttccatctacactggcacttcctgaactcagccaccttctggttttgcagctggctcagtgtcctgttctgtgtgaagattgctaacatcacacactccaccttcctgtggctgaagtggaggttcccagggtgggtgccctggctcctgttgggctcttgaaatttaaattttacgtattttatttttcatctttacaagtcttgtttagtttcttctgtttctaggcctgtgtttgttgaccaatctgttccaggttatgaatcttattttcctgattttttaaggtctagtaattttttactgaatgttgtaaattagaaatcttaagttatttaatacttggttttgttgttttctattgaagcattttagactttttctgacagttacttgtaaattagtttgatgcttttgatttttttaaaagcaaatttaggtcttacagggtttcacactactcacatacggattggtgtttagccaaggactcaaagactgatttctggaaccattttcctgtgtagcttatttttccctctaatctccgcatccttcactgagcaagatttccaggtactagattctgaggtctgagactaaagtcattccatcatgagttccaaactggacttgagaggggaagaatcatttcctttgagattgaccaataccaggagtttcactaaagaaggcaatgaaagacccacagccttggacataattgatttcctgtgatatctgtgtgggcccaggcatgctgctcacctgggtctttcccctctttcactcctttggaactgccccaccactaaccactttcctactctctccttccccaccccagtatctccttgcctcaagagtttcctgttactagcaataatttagttcactcccagggaactactatttctggttctcagttactaacctttccattcagttctttccattccatttttaccagaattaacgtttcctcatctttcccagtgaatgtaaaaggtaccttctgggaagcattttaccggaactgatgactgctatgcttgacagcagcttcaacagcctcggatacaactcatcatgaattagctctggcatgactgagttagaatactgttctgtttcctatctctacatgtaggaaaaatttaaagtggcatttctatgctttggtcttttctcataaatgacttaggggaaaacacttaatgaggatgagtaactaaaattcaatgaatactaaaagctttataagaatcatctaattgaaactttacataatttccttattatgtattaacattgaacgggcattatgcattccatttctagaaaagaagtctttccttaataaattacaagtgcaaacatgaagtccaggacaatttttacttcaagatcaacttgtctatatgctaggataatgaatttgaatactctttactgatgttccctgaagac

SEQ ID NO: 465601 - DNA, 2331 bp, Homo sapiens
agccaacatcctggacccccgaggctctcggatgatagagtggagacacttgaagccgttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagttcgagcttctgattgacccgccccggtatatccaagacctggacgcctgtgagacaggcactgtgcgggccaggtatacctttgggaaacctgtggctggtgccttaacgatcaacatgactgttaatggtgtagggtactacagccacgaggtgggacgccccgtcctcagaacatccaagatcctcggctcccgggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagtgggtgacggtccagattaaggcagagctgacaccaaaggataacatctacaccagtgaagttgtgtcccagggtggactagtggggtttgaaatcccttccatccccacgtcagcccagcacgtgtggctggagaccaaggtgatggcactgaacgggaagcccgtgggggctcagtacctgcccagctacctctcccttggcagctggtactcccccagccagtgctacctgcagctgcagccactctcccacccactgcaggttggggaagaagcctatttttctgataagtacacatgtccctgcaactttaccctgtactacgaggtggctgcacggggcaatattgtgctatcaggccagcagcctgcccacatcacccagcagcgaagcaagcgggcggcccctgccctggagaaaccgattcgtttaacacacctttctgagacagagcccccaccagccccagaagctgaggtcgacgtgtgtgtgacctctcttcgtctggccgtgaccccaagcatggtcccccttggtcgcctgctggtcttctatgtcagggagaatggagaaggggtcgccgacagccttcagtttgcagtcgagaccttcttcgaaaaccaggtttcagtgacgtattcagcaaatgagacccaacctggggaggttgtcgacctgcggatcagggctgcaaggggcagctgtgtgtgcgtcgccgcagttgataagagtgtctacctgctcaggtctgggttccggctgactcctgcccaggttttccaggaactggaagattatgatgtttctgattcctttggagtgtccagggaggatggtcctttttggtgggctgggctgacggcacaacgacgccggcgctcctccgtcttcctgtggccttggggcatcaccaaagactctgggtttgccttcaccgtaaggagaggtggtctcagatcccgctgcccccttctaaggtcctcttgcctagaaataagagtcttggagattcagaaatgggttggaaacagaattggaagcttttctttctttttttcgaaatggggtcttgctctgtggcccaggctggagtgcagtggtgtcccagaacagggccaagcattaaggagcttcaataaatatttcttgagtgaaataaaggactttacccacataaagaaggtgttgccctggggactggctgagagaaattacagactgttactcacttcaaaagaaacggactgctacagtggtacttacgtcaccagaaagaaacacttccacaaagaatttgatttgatggcatcatgtggacatagaactctcatagtaatgacccaacctgtgtttccagtcatcctgatgaactctcaacaaaatcagattgttatactgttgttctcactttacaccgatattttctcttgctcctaaaaaaagtatctggtattaaatagaattctgtatcttaaaaaacttgccattgagaaaaatgagaagtaactgtacattttaatactgaaggttttaataaaaaaagcagtgtgaactatctgttccatttttattcctcgtctacaaaagacaaaagtgtcagtattgagacaattgcttgataacagggatcacaaatattgctcttcctgaaatttttgcaaacttgaggtttactttctttaagattt

SEQ ID NO: 465602 - DNA, 559 bp, Homo sapiens
caactctggtcctcttggatattttagataaggactttacccacataaagaaggtgttgccctggggactggctgagagaaattacagactgttactcacttcaaaagaaacggactgctacagtggtacttacgtcaccagaaagaaacacttccacaaagaatttgatttgatggcatcatgtggacatagaactctcatagtaatgacccaacctgtgtttccagtcatcctgatgaactctcaacaaaatcagattgttatactgttgttctcactttacaccgatattttctcttgctcctaaaaaaagtatctggtattaaatagaattctgtatcttaaaaaacttgccattgagaaaaatgagaagtaactgtacattttaatactgaaggttttaataaaaaaagcagtgtgaactatctgttccatttttattcctcgtctacaaaagacaaaagtgtcagtattgagacaattgcttgataacagggatcacaaatattgctcttcctgaaatttttgcaaacttgaggtttactttctttaagattt

SEQ ID NO: 465603 - DNA, 1015 bp, Homo sapiens
  misc_feature (995)..(995): n is a, c, g, or t
  misc_feature (1000)..(1001): n is a, c, g, or t
  misc_feature (1003)..(1004): n is a, c, g, or t
  misc_feature (1011)..(1011): n is a, c, g, or t
  misc_feature (1013)..(1013): n is a, c, g, or t
tctctctctttcccccatgttttgggctgcaaaacacccaaaagccaaacacagtgggccacatccctggctaagttccaaggaagtgacagcagccttccaggagatctctggaaaattggtgcccccagggagggtgaaatcaaagaggccctggaggattggctgtatcttaggttccttggttgttctcccagcaaatgccagtacctctgcagataatcatccacagagtaaaacaacaggccagaagctcctggaagcaaccaattctccagttcttgaacatcacaatggctgtccaacaattcaattcaattatgacatgctttgcttggagttggcatcagatccctcacgtttaagggctcagctccacaagactacccccttcacatgccagcagcaaatatggggcccaagttacccacatttctgcccagctgactacaaattctggtttccatgaccccctctcaggtgaccagtccgcatcctgatactatctcggagtcccccagccaagaatcatctcatcagcataaactcaggcaatgttgaaaggcattcagaatggtactggccatgtaacatcctcaggaaaatggagaaaggagtcacatcatcttctgtgtttggagactgctatgtaagccagaatactagtcacacagtgcaggtgggagcggccgggaagtaacctcctttttttttaagactaatacatttatggtatacacctgaatttgtgttgcggaaatctgatacccattgcacacattctgtatcatgtttaaaataatttcaacttttattttagattcaaggggtacacttgcagttttgttacacgggtttattgcgtgatgctgaggtttggggtacaattgatcgcatcaccttccaggtgtcagcatgtaaaagggaagatccaaatgaccaatcaggagattactgggggaccacaaagttggggctcaggtcagctgaccagntgagnncnngttcacnangg

SEQ ID NO: 465604 - DNA, 1136 bp, Homo sapiens
  misc_feature (1116)..(1116): n is a, c, g, or t
  misc_feature (1121)..(1122): n is a, c, g, or t
  misc_feature (1124)..(1125): n is a, c, g, or t
  misc_feature (1132)..(1132): n is a, c, g, or t
  misc_feature (1134)..(1134): n is a, c, g, or t
tctctctctttcccccatgttttgggctgcaaaacacccaaaagccaaacacagtgggccacatccctggctaagttccaaggaagtgacagcagccttccaggagatctctggaaaattggtgcccccagggagggtgaaatcaaagaggccctggaggattggctgtatcttaggttccttggttgttctcccagcaaatgccagtacctctgcagataatcatccacagagtaaaacaacaggccagaagctcctggaagcaaccaattctccagttcttgaacatcacaatggctgtccaacaattcaattcaattatgacatgctttgcttggagttggcatcagatccctcacgtttaagggctcagctccacaagactacccccttcacatgccagcagcaaatatggggcccaagttacccacatttctgcccagctgactacaaattctggtttccatgaccccctctcaggtttgatagtttgctagaacaactcacaaagtgaaggaaaatggtgtacttactattactggcttattataaaggctacaactcagaaacagccaaacggaggagatgcacagagcaaggtgtgaccagtccgcatcctgatactatctcggagtcccccagccaagaatcatctcatcagcataaactcaggcaatgttgaaaggcattcagaatggtactggccatgtaacatcctcaggaaaatggagaaaggagtcacatcatcttctgtgtttggagactgctatgtaagccagaatactagtcacacagtgcaggtgggagcggccgggaagtaacctcctttttttttaagactaatacatttatggtatacacctgaatttgtgttgcggaaatctgatacccattgcacacattctgtatcatgtttaaaataatttcaacttttattttagattcaaggggtacacttgcagttttgttacacgggtttattgcgtgatgctgaggtttggggtacaattgatcgcatcaccttccaggtgtcagcatgtaaaagggaagatccaaatgaccaatcaggagattactgggggaccacaaagttggggctcaggtcagctgaccagntgagnncnngttcacnangg

SEQ ID NO: 465605 - DNA, 1682 bp, Homo sapiens
cgggagcctaaggcaccactccccgctacctaccgaggtgcatcctgcaggctccttaccgcaagcctgcaaactcgccctgccgggcgcggagtgcaattaggctttggggtggtttggctctccggctttccgtagcctctggccccgccccctagcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgtaagtgtattgttgatttttatcatgcagaaccaccaaagaagcatattccaggtgaagtttacaatggtctttcagtgataacttgtgtatgtagaaaacagaacattctcatatctctttgaatttgacagacacagtgggctcataaatgtaacacattaaaaagaaaacttttttgtagtcttgagctctttggtcatcttttgaaagttatatatgtatttttcagtttttgatttgcatatttttattctgatgctaaatatgaacaaatttgtaaagtgatgcccaatttagtttattaataattataaatgttactattatgttatttaataccattgataaaattattttttaaacactttataattatttataatatctgcccccactcagttaaatgttaagctaccaatgccagggccattctccatcctgtttgggaaaatagttctatgtgttatagctaagggaccttaatatatagtggtaaatgagccacactgaattggttgggaccaagacagtggcacgtgcactgtgaggatataatgttaagatgtacttcttaccttcatagtttctgtaatttctaatcaatctaggaagggagagaggatataaacaataatttcttaagttatatgattcttaatataggtggaaataagtgtctgtggtagttcaaaagaaagattatttaagactaaggaaaaatgggaaccagaagtcagttaaaaaaagacaatttaaaaaaaaaaaagaaattcagggaaaacagaaggaagtca

SEQ ID NO: 465606 - DNA, 1024 bp, Homo sapiens
atagaaatgagccactgcggccagcctggacttcctcttctgagtgccctgctgacctgccctgatgatgactgttcctgcagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggagtccttacaccccgtgaatttccagagtacccatccctcccctcccagctgccctgtgatggcttcaaagacggcaggtgtcagcccactggctcggtccctgaggatgctggccaagtgggaagtgggggacactaggaaggccccgcagaagccacccaaggcttcgtggcaaacgagcccagagcgtccctgtgctggaggggcagggcctggcagggcgggggctgcagcccagcttctccgcctggccctgcaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagt

SEQ ID NO: 465607 - DNA, 1419 bp, Homo sapiens
tcatctctctcaagttcaaagttccgcagatctctagaaggaaccagaagctgactgaagagagttagggatggttgtatgggcagatttcttgctgcttggggtagccaaaaggaggactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgacctggtggaagagggattccagattgaggctccagccccaattatgcttgtgctttcctcctgtcccgctgtctttcatgaatctggaaatggaaccatatttatccagaacctcgcctgataccatttcagcaggacattactaaattttccactcttttattttcttgttctaaatattcactttagcctacttaagttgtttttagattatgatgggggggtggatagttagatagctattagtgtgaattgataggactaccataaaattactttttgatttctggaacataacagcagaaaatgtattgaccttttgcaatttgaaacaatactttgttgcctcatattcaaaatgcagtcttggtttctagcatacctggaaatgtcagtttaccttatttgtgtctttctgtgttccaaaaaaggatttatgttcagctgaataagccgatattattctaaactatggaaatcaaatgacctgagttctattctagcattctaatgaatcatttgaatgaagcctgaaaaatgaacattaacaagttactgggggccagtgactcacacttgtaatcccagcattttgggaggccgaggcgggtggatcacctgaggtcgagagttcgagaccagcctgaccaatgtggagaaaccccatttctactgaagacacaaaattagctgggc

SEQ ID NO: 465608 - DNA, 1790 bp, Homo sapiens
caaatactactgaatggctctctaaaatttacatgaaggaaagagctattttatgctagcacacagaagaatccacattgggtagtaaacaagacaagagactaatgggaatccaaaatcagactcactggataactaagctttgtgaacaccggcagtgaaggaaatatgaaatgggcccagcaggttctccaacgacttcaaatgttttggtcaaacttcgcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcacctctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaaggtacacgcgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtg

SEQ ID NO: 465609 - DNA, 2773 bp, Homo sapiens
caccggaagctgcacgctcggggaagcgcggaggcgggggtgctgcgcgcttgggagcacgtgggggaacacgcagggactgccggcgcgaatggcttcgaacgcatgcgccccacccgacatttcacagtcgccatgacgaccggtaggtccgcaacggctgcggggacaagaccgttgaggctgccaggcgagtcaggcctttctggacctcgcctgactcggctgggctgtgcctgaaattgacccagctctatcagggattatgaaaaaacaaggagtaagcccgaagccgctgcagtcttcccgccccagccagtctaagcggcggtgcgggcctcccccttcccccccgcctccgccccggagccggaggtagaggaggtggaaaagtcggccctaggcggcgggaggtccttccggcggaggatccgaaatgtggaaaatcgaaaaggcttggagctaaaggtggtggccaagacccttcttctcggccccttcctgttggtccgtaattccctggcgcagctccgggaagaggtgcacgaactgcaggcgtggtggttccccagcagaaccactttggacttcgcagtccttgtggcttatctacattggttacatttagtaaaactttgtgaaaattatcgtcatttctctcacctctcatctttggaacgggagatgactttttgcaccaaaatggttaggtttcttcttctaacgaattaatttgtggtttaagaatagcgagactatgaggtagagatgtattaggaattgaaatgaacttttggtgaactgcactgtttcataaagctataacccaggtttattatttaaatagtaaagtgtttgagattatttttctgttacttcattatctctcaccctttcctaatgcagacttctttttaagataataaagatgaattataatagctgaggaaggagaagaatgcaagctctgaaatgacatccttaaatgctgatactggttacaacctctttacctctctgaggaaattggacgcgggtgaagctagaagccatcgttctcagcaaactaacacaagaacagaaaaccaaacaccatatgttctcactcataagtgggagttgaacaatgagaacacatggacacagagaggggaacatcacacaccagggcctattgatgtcaacgggctgaaggctttacccacccaatcctgctccccctcctctaacagctatgacaccttcctagtttcaccccttcacccattccaggacccgcccggcatcacacgttctgcttcagcaacaatgaactgctggaaatttccagcaactctttttcctgccagtgctcacactgtacccttgcctgttaaggtcttacctgtcttcctcgcacacccctgcctctcacctgctcagacgtcccctcctgccagcagccagtcctgaccatcccctctgtgatctgctaatgccactccacctgtcacatagttcgatcacttaaaaatgatctgttttcctttgaagtctttcattgaactctgaattacttaataaaaaggtttgtatattatttattcctgttttccacccgacacagtacctggaacatagtagatgctcagcaaacattgcacaaaagaataatgtggaaaataaatggttaaaacatagaaaaattttaaagatagggtatttgggtcacttttactgttttctgtccctacaatatggctgaatcatcccccatatggctcaacattttcttaattcttttaaaagtacccaacactatattgagtgctctggggatcaaaataatagtatatatattaaggctgggtttgaatctctgctctaccatttactagctgggcaatttatataacattttaaaatttcatcatctgtaaagtggaaatattaaaggtatcttcttcaaaagtgacatttggaagaaaaaaataaagtaatacatataaagcatatgagattcagtaagcactcggttagtggtgagttgtttttgttgcttttgctaagacccaggaacccattgtttgaagatcagcatagagcactaactggttggatgggatttctgttctctactcaatgatttgtttattctttagagactgtctgtcccctctagagtctattattaatattttctaatgccaatttatgggagttttactattgtgctgtttctctaataatagctaatttatatttttaatttttaaaagccattatgctggaaacagagcattcatacaaacaatacacgaatgaatgtaggttatactgcaaaatagctggttactataatgtagttgtattccatggctttaagtttaaaaataacttcgcatttactagagtggacttaccctccaggcataaaattttaaaacccaacaactccaggcctccagagtctttacttcccactaacttctcaccagtgaaggcgaagctaatgaaaaaggatagatgactgcttctcaattggaaatggatccaaatgccatcaagggaattggtgtcggtatacagattttacctactgtcacagcctggttgggtggaggatggggaaggtggtggtatcggtctacttttagagttttaaatgtttctctgaattcctgtagcagacaattttgagaaaattttgcctagagaaagagtctgaaaccaaaaagctaagcagaggcaaaggtttgcagcttggatctttaacattaataagtctgttgct

SEQ ID NO: 465610 - DNA, 603 bp, Homo sapiens
caccggaagctgcacgctcggggaagcgcggaggcgggggtgctgcgcgcttgggagcacgtgggggaacacgcagggactgccggcgcgaatggcttcgaacgcatgcgccccacccgacatttcacagtcgccatgacgaccggtaggtccgcaacggctgcggggacaagaccgttgaggctgccaggcgagtcaggcctttctggacctcgcctgactcggctgggctgtgcctgaaattgacccagctctatcagggattatgaaaaaacaaggagtaagcccgaagccgctgcagtcttcccacacccagccaatttgttgtatttttggtggagacaaggtttcaccatgttggccaggctggtgtcaaactcctggcctcaaatgatccacctgcctcggcctcccaaagtcctgggattacaggcatgagccactccacccagccagtgaaataactttggtgataaagttttagcaacacctgccaattggaaatcaggtaaaaaagaagttaaagattctgcagtggttatatggttaaatggctctgagtctttcagtgtgcaagcctgtgtacattattttacaaaagtg

SEQ ID NO: 465611 - DNA, 431 bp, Homo sapiens
acccaacccattccttgttaagtttctatcagcatcaattttcctccttcactataatggtacatttattactctccaagtcataatagtagacatatagagtagaagaagacaaaatcagttaatgtgttgatcacagcgctatgttgatagagctaatgtggttcagaaaagaaatactattaaagttcctctagttctctctccagctgaagacaattagcttaataaccatttctactcattatttccatgctaactagttttatctttgcattttttaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaa

SEQ ID NO: 465612 - DNA, 755 bp, Homo sapiens
tggataggaagaatcagtattgtgaaaatggccatactgttcaaagtaatttatagattcagtgctattcccattatattaccatcgatattcttcacagaattagaaaaaactagtttaaaactcgtatggaaacaaaacagagcccttattagccaagacaaacctaagcaaaaagaacaaagtgggaggtatcaggctacccaacttcaaactatactacaaggctactgtaaccaaaacagcatgagaaagagagagtctttggagagttgtgaggagataagtgacataaactggcatgttctgaaagaatcactctggatgctgtgtggagaaaacactgaaaagggtttgaaatggaaattacaagcgcaatattacagaagtgtggattttagttacaatgtctctatgagaaagtctaaaagttaaacataagcaaaacaacaaaaacatctaaataccaggaatttgttatctcgattatggagggcgacaagtcccacagtctgccatctgcaggatggagaaccagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggtaggtaggcagttctcaaactgtgaagctattgga

SEQ ID NO: 465613 - DNA, 866 bp, Homo sapiens
tggataggaagaatcagtattgtgaaaatggccatactgttcaaagtaatttatagattcagtgctattcccattatattaccatcgatattcttcacagaattagaaaaaactagtttaaaactcgtatggaaacaaaacagagcccttattagccaagacaaacctaagcaaaaagaacaaagtgggaggtatcaggctacccaacttcaaactatactacaaggctactgtaaccaaaacagcatgagaaagagagagtctttggagagttgtgaggagataagtgacataaactggcatgttctgaaagaatcactctggatgctgtgtggagaaaacactgaaaagggtttgaaatggaaattacaagcgcaatattacagaagtgtggattttagttacaatgtctctatgagaaagtctaaaagttaaacataagcaaaacaacaaaaacatctaaataccaggaatttgttatctcgattatggagggcgacaagtcccacagtctgccatctgcaggatggagaaccagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaa

SEQ ID NO: 465614 - DNA, 2926 bp, Homo sapiens
gggttgggaagggtagttggggggtggcggggaagtggagatggagagcaggtgagcctggccgcgcacgaatccgagggggcggccgcccagctgggaagcagccctgaaatagacccccgccgcccccgctgcctccttccggaatctgctcaggtgaaaaacaagcctctcaatccgggcgtgtccccgggcgtgggacggggaggtgcccagcactgtgggaggcgtagactgggcctgggtcccgctcggacccgccccaggcccggccgctgggtgcaatgagggcgttcggccaccgggcggcggtgctggcccgcgatggggagcctggctgcagcggctgtgggcgccggggcaagcggctgcggccccctcgcccccttgcgcttcccggctctcccgccctctcccgcagcctcccctctcagcgccttcctcgctctctcgtctctcgctccctctctcgctcgctctccagcgcgctctctagctcgctctcattttttttcctgctgctgttgccgctgttgcggcgccgccaggcgcccgtacctcggccggctgcgctcgctggtcgctcccgctccgctcccttcccagcccggagctctcggccagacccagctcctcttgccgcctctcccgctccttccggctcggacgccgggctccgccgcagcaggagcaggggttgccgccgatctccctctcgcttgctcgcttgccggagcagcagccgaacgccgcgcgcttggcggcggctccggccgggcggccgccagctcatccctgctgcgtcccggactccgggcggctccgcggcgcgctgggtccgcagcgtcagcgctgcccgccgcggcccgggctctgggcaccgcgagaaccgtgcctccggccgtcgactgcctgcgcccccggggcaggccggcacgcagccgacccctcgccgcggcttaaaccttgctggcgcgcggtgagttgtggcccgagggggaccgacagaggggaccgtgccctccggcctcctggggcgagggctgcggcggggacatcggggctcggggaggtggcctccggcgagctcccgcgcttggagtgctccgaggagagctggcgcccccggagccctaggggccggagggcgcgggatctgaactagagggtctcccctcggggctaaggcaggctttccgggtgcccctgagggagggaatggggcagaggcttttttgcgggcccggtggaaagtactgtctctgtatacaggggcttccaccggatggagggtcgtgccagctttcaggtgggggcggcggcattagcgcatcccggtctgcggagaggcgggacaggcgggggcgcggggcattatttgcacctcttcccggcagtctcccggcgggagggcacccagcctcgcgcgcctcggctcctttcccaggcaccgcgtccagctcccgtgcccgccccagcgccgccttcgccagcggccggagcccggcaaccgcttgcccgtggcctcggcaggttgtgggggtctctagggtctggggtctccctgcagccccaggacttcagggtcaggctctctccggacactcgggaccgtccctccccgggaccgtgatgaacctgcgcgtctacgcggccgccgggcgagcggaccggcagtggtctctgtgtgtgcatgtgtgtacgcgcgtgtgtgctgggggtccccgctccggggtcggtcttccccggcgctcgcaggtgggaggcgtctcctccccgcgcgggggcggggccgggaggtggaggcctcgactgcgagaggcgcccccgcaccagggcggtctgaggctgtttgtgctgagatggggcagcagcatcggcggcggcagggagtcctgaggcccgaacgtacgagcgccccctgcccctaggccttgagtgacatcccgccctcagactttcagtccctgtcggaggaggcgccttgcttctttctcccctctccgcaccattgccggcccctggcgcgggagaacgcggcctttccggacaccgactgagctgggcttgcctagctgggtgcccgaagccacgtgtctctcagagcggtggctgcccctgtgtcaatctggcagaaagcccgaagtgacagggagggaggggcatcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaaggtcagtgccttggttggtcccctgagccttgtggcgctgaccgaggtgctgaaacagcacctgccgctggaggctcgccttgtggcgctgaccgaggtgctgaaacagcacctgccgctggaggctcggacaggggtgctgatgggtgtgaagaataccttttggtgggcacccaagcccagtggttgtagcctgtacaatgcactgttgtgggcccagcccaggttgtggagaaagtcaggcctgggtttgaatccctgatccactagttacctcacctccacttaccatgtcagttattta

SEQ ID NO: 465615 - DNA, 1317 bp, Homo sapiens
cagctgatttctcagggtggttctttctataattcctgaacaacgttggtttcttttttccactgataatgatgctgacgtggatggtgtctgtggccagcatggtcagaaagttggtgtatgagcaggagatacagatagaagagggtgtgcaaatgtgtccatctgttagatcaggggtccccaacccctgggccatggagcagtccgtggcctgttgggaactgagccttacagcaggagggattcaatggaataatatgtaccaggctctggaacaagggggcatgacatttggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcagttagtaaacagttgtctctctgctcctcctgcctctgcccattgtgtaaggaagtgaagacaatagaaagagacacttaaaaaatcatctgtgtctacatttataagatgaaataattagcaaatggttgttaactatggaattatgacacagccaccaacactgagaatgtcagaaaaggcttctgtgggaaggcattgaatttgatttgatttgtctttgaaatgtggaagagatgagcacatgtaagcacagaggctgttgatggaaactttgtgtatctggagtaaaaggtccctaggggtgtcctgaaatgaaaagaattcaaaggcagcgggaaaactggttgtcaagaagctgattagtctgccttttctctccttgatccctagctcttcctcaa

SEQ ID NO: 465616 - DNA, 1856 bp, Homo sapiens
tccattttcagaaggtggatttggtgagcatgaaaaaagggggtgggggagtaatcatacaaacaattgtgtccaggccagcttcctaggacatgagggctccctctgtatggcagaggcacctgacatccgtaactgttgtgcaccctgcgaatgactttatggtctaagaatgtatgttcagagccccagctaaggaatcaggagtggcaagatcctggaaggatgccaatctatgaaaccctgagtcaagaggtcaagctgggcacttgttttcctttttctttttttttgtaggagtttcactcttgttgcccaggctggagtacaatggcgtgatctcggctcactgcaatctctggttcaggcgattctctcacctcagccttcccgagtagctgggattacagacatgtgccaccatgcccagctaaatatggagatgcggtttctccatattggtcaggctggtctcgaactcccaacctcagggacggggtttcactatcgttggccaggctggtctcgaactcctggcctcaagtgatctgcccccctcgggttcccaaagtgcacctggcctctctccctgcatctttatgtgcctgcaacaccaagagggagctcttggcccctgggttaaggtcagggctccagaagcccagggtcaaggctatggccgcatcccaaggacgtgcatccctgcaagaggctgcatcagacaggcatggaagaggcgccgctggggcctccttgaattcctgctgggaaaagcaagtggaggtgctccttgaagaaacagggggatcccaccgatctcaggggttctgttctggcctgcggccctggatcgtccagcctgggtcggggtggggagcagacctcgcccttatcggctggggctgagggtgagggtcccgtttccccaaaggcctagcctggggttccagccacaagccctaccgggcagcgcccggccccgcccctccaggcctggcactcgtcctcaaccaagatggcgcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgcctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtg

SEQ ID NO: 465617 - DNA, 1829 bp, Homo sapiens
tggccttgactccgtcagagactgggggaagaaatcgtgagtcagggcagcgaggtctgcggggagcgttgtgaaggtgtgaagtgctgagctcccaggtccctggctgccaccatgggctcggagccgcgtgagatgggacaggagctgctgtaggttcagtctacctgggaaagagggagagggatttgctcaccaaatcccatgtcccattcgtcaatgtctgccccacgaggtattaatttccagcactcccggagctgcctgaatgtgggcccccaagggtcccttggagttgagatctcaaaggcagttgacaactctggcaaagccttcacttcttgcttgagcacagctttaaggccagccagagcttacactgcagcccgatggaattacacacagtgccctgcatatgccaaggttcttccacctctagtcatgctgcttcctgtcctgacacccccttcccaactcgatcctgctgagcagcctgggatctgtgtacgggacgcccctcagagtcacccagacacaggggaagctggggtgtttattccccgcccctcagtcacaggtgcaggcctgctcctggggcactcaccccagcatctccaacgctaaggcagctcagagagccactttcctgtccaaggaacccttagagaccattcccaggaggagcgaatgtccacctgtgtggcgtcctcctggggcgctccttctaggggggaccccagtccctcctgcccttccacccagaatcctcctgtctcctgggtgaaaactggagcccagattctagctctgctgtgtctctcagactctggaggtctcagcagagcccagagctggctttcccagcagggccccggggtgctgatgctgctgcccctaggaccacccctgagagccctggctctccaccagagcctgctcacctggagacagtgaccacaggccacaggtcacccctcactgcttcactccacgccctctcctgtgacctcatctcctcccacctccccctgggtcacgtggctccagccacacccacctccctgctgttcctcacccaggatcaccaaggtctctcctaccccggggcctgtgcacctgctgtgcctctgcttggggtgctcttcccagggcttgcccacctcctcagagaggcctcctgacccctgacacggccttgcccttcacctctatcgtcctttagaacagcccccacctcccgcacatcatgcagttgcaggttcaatggctactgcttgtcctccagactcgataggcctcatcactcctcagatgattctcgaaggataacacacaggccagtgggcagccctaggccagggggattaccaagacatgaagactttctttctgtctcagcaaccttcatgcttggtcaagcaaaggtgttgcttaagtcaaacccagggcaggggagagcagttgaagcaaagtgagtctttggaggccctgtggttgtggggtctggtgtggagacagtgagaacggaaaaggtgggagaggagcagtcaacccgtgaatggccccattcagacgcctttacctggaagacgtggcaggtctactggggttcatcccatctgagccaggcctggcttttcttggctgcaagctgagagctgggtccaggtctgctgaaccaaggttctcccatcttccttgagccagtgacaatcagaggcctatttctttcatgacggaaggcaggagaacaagcaggcaagaccagagactccacctctaggtgcacaaactacagagtcacggacagagaacacagatctagggaa

SEQ ID NO: 465618 - DNA, 317 bp, Homo sapiens
tcttatactaaggattttcagtgttttttcatgcaccatccaatcttttttgactcttagatcatatgcctcagagcccatctgggtacaaaaacacccgttttcaaaaaaggaaccagaaagtggtttcatctcgctttaggatgtgaatgaaagcctctccttccgtctcccgagaagggactttcagaagctgcaggtgcccaggtccaggccccacgctgtggccccgcagggactgtactcactctttatttttctcttttccagctctccacaagccaacagctctctcctggctttgattttcaaccatt

SEQ ID NO: 465619 - DNA, 2137 bp, Homo sapiens
tggccttgactccgtcagagactgggggaagaaatcgtgagtcagggcagcgaggtctgcggggagcgttgtgaaggtgtgaagtgctgagctcccaggtccctggctgccaccatgggctcggagccgcgtgagatgggacaggagctgctgtaggttcagtctacctgggaaagagggagagggatttgctcaccaaatcccatgtcccattcgtcaatgtctgccccacgaggtattaatttccagcactcccggagctgcctgaatgtgggcccccaagggtcccttggagttgagatctcaaaggcagttgacaactctggcaaagccttcacttcttgcttgagcacagctttaaggccagccagagcttacactgcagcccgatggaattacacacagtgccctgcatatgccaaggttcttccacctctagtcatgctgcttcctgtcctgacacccccttcccaactcgatcctgctgagcagcctgggatctgtgtacgggacgcccctcagagtcacccagacacaggggaagctggggtgtttattccccgcccctcagtcacaggtgcaggcctgctcctggggcactcaccccagcatctccaacgctaaggcagctcagagagccactttcctgtccaaggaacccttagagaccattcccaggaggagcgaatgtccacctgtgtggcgtcctcctggggcgctccttctaggggggaccccagtccctcctgcccttccacccagaatcctcctgtctcctgggtgaaaactggagcccagattctagctctgctgtgtctctcagactctggaggtctcagcagagcccagagctggctttcccagcagggccccggggtgctgatgctgctgcccctaggaccacccctgagagccctggctctccaccagagcctgctcacctggagacagtgaccacaggccacaggtcacccctcactgcttcactccacgccctctcctgtgacctcatctcctcccacctccccctgggtcacgtggctccagccacacccacctccctgctgttcctcacccaggatcaccaaggtctctcctaccccggggcctgtgcacctgctgtgcctctgcttggggtgctcttcccagggcttgcccacctcctcagagaggcctcctgacccctgacacggccttgcccttcacctctatcgtcctttagaacagcccccacctcccgcacatcatgcagttgcaggttcaatggctactgcttgtcctccagactcctctccacaagccaacagctctctcctggctttgattttcaaccatttaagttgaaaaaaattcaaaacaaatgaaatgcacttaagagaaagccttgaggagttcagcaggccacccaaagtgaagggactcctttgggggtctttgttgttatcaattatttattgagccctgatgtgttcctggcgccaccaagaccgaaaggagacagggtccctgccctggggcatcccaacaaagaagggagagtttgtgaagcttaaaaatgtcccagatggtaaaacagttacacgtcatacctcaaggctgctctatacttttattatagttttattcttaaggctgtttatttattttctgatgtaaaaggagccttgttatggaacctggtggacaaaccattttaactggacatgatgttgctttttaatcaatgactcctgaaattttaggtgagtatgagtctggagttttagattacaaacaacaggaagccaattcaacccagctttttaaaagaagatttctaattaaatgtgttgattctgttagcagagaactctgggggcagtgtgggttgcaggcatgggtagatccaggtgtcaaatgacattctcaggacccatgctctctccatcattggctctgattgctcaggtttgggctccattcttgggccactctcttgctctgcagcaagatggtcaatggcagctctaggctctcaccctcatcttcacatctctaagtccagaacaaagagctttccacacctgctacagatctgggagaagatgatcctatctttcttgaacctgaggctagtccttactcctccctaagttct

SEQ ID NO: 465620 - DNA, 658 bp, Homo sapiens
agcgcgacttccctggccctccccctgcggaccagtgaacctcgcccgagggctcaataaagaagatttttgccctctttttctcacctctcagccttattgatccatggtgcccttccattgcctttcattggtgccgaaacccgggaggggacacctcctaagcccccccagaggctcagggggactcccctcctggtcggatcagtcctctccctcagtcaggtcaggcttctcctccacggccatctgtccatttcgtccggttacttgctgccaggtcgcagttgctgcagctactccagtccaattcggccgacgctagatcaactgagatgcaaaacccatgttcacatcatgagtgagtcttctaactcggacaatgcaatcaacaaattctaagaccaaattccggtggcactggctccaaagctccttgagttgtgcgcaaccgcacgtcgaaccaggggaaaaagcagagagcgacaaaaggtcactattcccttcccacacacagacccattactgggggaacgcgtgcacagactttaccctgccgactccagcttcaggacttctcgcttacccatcactgggcattgcccatttcgacaattcacgaatcaagaactgcttgcgccttctacactctgcctcg

SEQ ID NO: 465621 - DNA, 1272 bp, Homo sapiens
cggccgctgtggctccacatggcgacccctccctggatggcgaaggtgccctctagctcctccaactggatgacgactgaagaggcccaggctcgggaacccctctcacccttgccgagcccagggtaatgcttcaggtagcggagacaaatgaagacactcgaccatctctaaatgctaccaaacacatagagtctactctgaatgcagatactgctctcataaaaattctgcaaaggaggaaggggttggtgcagaactgttccgatgctgatcaactgagatgcaaaacccatgttcacatcatgagtgagtcttctaactcggacaatgcaatcaacaaattctaagaccaaattccggtggcactggctccaaagctcctgagtgtggaaggaggtgaacagggaaaagcagagaggacaaaagtcacatcccctccccacagacccatactggggaagggtggaagatttagctgcgagtcaaagaaacaaagacagttggcgacacacgctgaccgccatgcggacgtccatcaaacccagcactggccctgggtacgtgcgcctttgctattaccccaatacattttcttctgcagagcaagcaacagaacacatgcagaccttaataaataccactggggtccaagccatggacatatggacaaatgcccttaagcagcctggtggggacctgtcacactacaacattggtgctgctgctgctcctggtggaggttgcacgagggctgagatcgtcacaagtaaaagacacctgctgcttgtcaccctcgtcctaggcatcctgcaaggacgttcacaatgccagctgctcagtgacgtcttccccgaggtggaattttgttgctccccacccccgactccttccccaattgccctttctactgttacaggctcaatgggacatgaagaggaaccagggcatcctggaagagctggggccgtaaaggggacacttaccaagcctgaagctatggagacaggggatgcccctagaaccaggaatcgaggcttgggggcaggaaactgtatttctacacctagaacagtgccgggcacataaaaggagtttaaaaactattcattcagtgaaggaaaaaatgaacacacaatcagggacactcccaggtctaaataagacacattgtttatcagacattctgagttcatttcccagactgccagtgttgacttccccagaattctgtcttttgattaatatgaccaaaaccactctcctcctcac

SEQ ID NO: 465622 - DNA, 795 bp, Homo sapiens
gggctttccaacaagcaacttggaaatgagcgacggttgaagctcttcaacaaatctctcctcagccaaatacatctggtaccttaatggaggcgacagcacaggcttctgattagttcacacatcactcaccaattagaatagaagtgcatttacagtctgcaaacaaggattcatcatgggaaactgtttttaaagtcagaagatcttgattcaagtccaattctgcccgttaccatgtgaccttgagtgaatcttgtaatctctcttttaaaaatacagacagcaacacttgccccctccatttacggcattacaagcatctgatgggatcacacatttgaaaatatattgtaaaacatacatgaatatatggtgtctagttatcaagactccaggtcctgtgccttccaatgaagttgtgatttcctaaccaatattaattaattaactaatttaaaaaaataaacaatggcatctccttctaaactagtttttaagccaaactatttactttatccctttgctgtaaataaaattttaaatgctaacttcagtatgccaaataattaaacgtaggcaattcttttcagatgtctgtgtcttattaaccttatgctaagaaccaaattctggcttatctatgatgctatgtgagaaaaaccacacccaacatggaatttgtatggttagacagaaactggaatgagtgtatctcttagagggttaaagcaggctaaaggctgcaaaacaactaagactgaaaagattgcaaaaaaaaaagatgtttatacc

SEQ ID NO: 465623 - DNA, 1845 bp, Homo sapiens
caccacagctctctctgttaagatcaaggctctgctcacacatgcttgagctgccagtgggtgaacaccaggaattatggttcacctggggccaccaatggaatgtcttactacagtagacaagtgggacataaaagtggggagacaaagggcagtatcaatcgattcacaaactaaattggttttcacctcatttgattcacctgatttagataagctgcagaatgctaaagggataagacaaaacgtagcagccagaagttctggggctgaagggagatgtgatggtattttgcagaaagcgttgccagatcagtacaagaaactctccacgtcagttttaaccgccaactcttggaagaaagactccccttatcaaacaccaaatgccctcaaccaagggaaagttctacatggtgccattactgtattatccaactttcttcaaaaactggctctcccagaggttgcacttgggtatctgaacattttggacaaagtacttgctgtgaccacatacagctgcattgaacagaaacccaacatcagtggtataactaaatcagggtctgtttttcttgcataccaagcactccagggctgcacggctgccacactgacttgaggacctataggatgggtttctcttggttttccaggctgccactcttaagtgcattgctttcatcctcttacttgaaagatggatgctatagttccttacaccgttcaatatggagtgattgccacgtgtagctatttaagcttaaattattttaataaaattaaattaaaaattctgctcctcagtcacactagccacatttaaagtgctccatagacacaggggctagtggctactctatggacagtgccaatggagcacatttccatcatcgcagagagttctatcaaacagtgctgctccggacagcacatctgcaaagagaatccataggtttatgaattgaaagccactaatataaatcatccttggtaatgaaaagtgaaaaaaaagacataatataatttctatttgtcaaggtataatgatgtcaccatccatttatcctctgcacttaaaggttgaagctcttcaacaaatctctcctcagccaaatacatctggtaccttaatggaggcgacagcacaggcttctgattagttcacacatcactcaccaattagaatagaagtgcatttacagtctgcaaacaaggattcatcatgggaaactgtttttaaagtcagaagatcttgattcaagtccaattctgcccgttaccatgtgaccttgagtgaatcttgtaatctctcttttaaaaatacagacagcaacacttgccccctccatttacggcattacaagcatctgatgggatcacacatttgaaaatatattgtaaaacatacatgaatatatggtgtctagttatcaagactccaggtcctgtgccttccaatgaagttgtgatttcctaaccaatattaattaattaactaatttaaaaaaataaacaatggcatctccttctaaactagtttttaagccaaactatttactttatccctttgctgtaaataaaattttaaatgctaacttcagtatgccaaataattaaacgtaggcaattcttttcagatgtctgtgtcttattaaccttatgctaagaaccaaattctggcttatctatgatgctatgtgagaaaaaccacacccaacatggaatttgtatggttagacagaaactggaatgagtgtatctcttagagggttaaagcaggctaaaggctgcaaaacaactaagactgaaaagattgcaaaaaaaaaagatgtttatacc

SEQ ID NO: 465624 - DNA, 1381 bp, Homo sapiens
  misc_feature (1)..(1): n is a, c, g, or t
  misc_feature (3)..(3): n is a, c, g, or t
  misc_feature (7)..(8): n is a, c, g, or t
  misc_feature (11)..(11): n is a, c, g, or t
  misc_feature (14)..(14): n is a, c, g, or t
  misc_feature (1375)..(1377): n is a, c, g, or t
  misc_feature (1379)..(1379): n is a, c, g, or t
ntncccnntgncangactgcagggcgatactggctatacttgcatcacccttctctgtgcctgtagaagctgaccactatgaattgtaccaactggtctcccttatctcccttccctgacttctggttgggttctacaaatgaaggactgctccctcagggtataggggcagggggcccttcccaacctctaacattcccagaccaaacacaagcagatcccctggctggacttgcagctcctgggggaacacatgcctcatgtcctggaaagaacacagttctggagtcagaggccatcatttcatctgggctaactgtgtcttggtccctgactaatattgatgagaaaggggagcccagcagacccagattccctagtgcctccagcccttccagatggtccattggcaggaagcttgctatacaaatccatcaggctctggaagatgcaagacaaaagctgagagataatctcagaagtgacatcccttcacttctgcgcttcttagaatggaagggattaggcaagggtgtgaatgccaagaagtgtgaatccctgaggccatttcggatccttaccataaaagtggaagtgaaacaaggttggatgaagacacaggacaaggaggaatgtaccagtggggactggcatggggatacagaacaaggtggtaatccaaaaaaggggaaacatgggatcaagaaaaaaagaacacaagacagcagtaaagggaattcccaaatgagatccgtctcagagcagtgccaaatcaaagaaacattcacaatcaaaatgctacctgctccccagtgccactccactgaatccttgcagaggcagcacagtcccgagtatggtactaatatcgagatggataaggctcatcacagctcaagattaactataaattcctaatgtgttcaggtaagatgcatctctacctcccggcagacaaagaggcaaacacaatgatccatgaaagaaagaaacagagatgctgcccaagtgaaatgagccttgatatgtcaccttcctcaccttgtgtttttgtagccatacctccagacttccagatctctgcctgaggtttactgatggtttctttcagggatcattaaaagtgattcgtgggctggcaaggcttttgttttccatgctaaggattcagtttatagcatgcagcttgggaaggggtgtctggaggacggcatccccatccaggaaatctactccaggaaggccaagaaggcttcaacagtccatgggtgatccgtgatgcttgagtgggaggaagtggttccatggggatgggcattcattgcaaagatttgacgtggtggaaaagggaaaaagaacaaaggagttggaaggnnntntt

SEQ ID NO: 465625 - DNA, 2652 bp, Homo sapiens
aatgaacagtctcaacgatttactttgaaacaaatcgtcctgctgcactctgagggcgggcgtctgggtctccatcccggatctggggcggcatcttggggtagaaactgacacaaagccgggcctctgcggtccgggggcggcggccaagctccgcctccacccgcggcagccaatcagctcccggggacgccccaacccccaaccgtctgcactgcagcccacctccccccacacgcctcctcctagccacttcactaccaatttgcaaattcccaaggcgtctgccccagcgccttcccacatctctgtggaagactccccactccaaagtagcctggtgtggaaattgctggacgaaagggtgagtctcgtccaaagctggtttcggggaccagaccaggcccgggcacacggaccaattcaggggcggctcccgatgcagtccgctgaggtgcgggtgggagaaggaggcactgggtcggggtccttggggagcgcggccgaggggggcgcacgcggggctgccaaagtgccacagcaatgccaagccaccagggccggcgacacaaagaagcgctgtcccccgccaagcgccgccccctggagctcccactccagcctgggaggaagtggggaggaggggactcccgtggaaacccctcctctcctccagctccagcctcctccccgctcccaaatcccggctcggtcgcccagtcactggtacagggaagcctcttccctgtgcattcctctctgcgccaggctctgcccgctcccacctgcccccgtggaaatcgcagggtgacctgaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaagattgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggtaaggaacaagggttggaagctcagtattatgggaatgggggaatggggacaggctgacatcagcagtccatttcagggacccgatcatgtccagaaggtggtctccattttttaccatgaactttgaagaagataagggttgggattttaagtactgtttggaagagttgagtcaaggcagcatgtaggggaagatacgtgcttac

SEQ ID NO: 465626 - DNA, 2032 bp, Homo sapiens
gtagtttcgagcccgctgccctttgcctcctgggcggagaagctgcttcctcctgggaacaaccgcctcccgctcctagcaggttgctactgccccgaacccgcgctgcagggaacagcggggcaaacagtgagtggggttcagcgtagactctggaccaggagaggcccgcggtgaccgaggcctgggccccggaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaagattgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggtaaggaacaagggttggaagctcagtattatgggaatgggggaatggggacaggctgacatcagcagtccatttcagggacccgatcatgtccagaaggtggtctccattttttaccatgaactttgaagaagataagggttgggattttaagtactgtttggaagagttgagtcaaggcagcatgtaggggaagatacgtgcttac

SEQ ID NO: 465627 - DNA, 583 bp, Homo sapiens
gtagtttcgagcccgctgccctttgcctcctgggcggagaagctgcttcctcctgggaacaaccgcctcccgctcctagcaggttgctactgccccgaacccgcgctgcagggaacagcggggcaaacaaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaacaagacaaaaaacaaaaaacaaaccaaaaaaa

SEQ ID NO: 465628 - DNA, 574 bp, Homo sapiens
tcgtaatgttttaagaaagtttatgaatttgtgttgggctgtattcaaaccttgggccgtattcaaagctgtccttggccacatgcggcctgtgggccatgggcagaagaggagtctttttagtctgcatgagggagagctgaactgtgttaggcaagagaattttgttgtagttgatgttgtgcttaatattggtggatggtggatattggccttggggccccttaagcaattgaatgaagcagacacctgccacgtttcctggctgtccagcaactttttaaactcacctttgctctacttgggaaatgtcctgctttgcgatttgcctgagatcacacagcctcgtgtgtggcagagccttagattccaagccaggctgtccgatgccagaccttcacagctatcctatgcttccacggcaccccggacttccccttggagcacttgccagtgaaacaaacatgccctggagaaatgcctggatggggaaatgaagacttaagaaacttaggtaatctgcccaaaggcttatagccaatacatggtaaagctgagatgtgaactcaagtat

SEQ ID NO: 465629 - DNA, 2811 bp, Homo sapiens
tcagctcccatgtgttgtgggtgtgcacctcccgtgctccccggactccttaagagggagtattttccctcttaaggagtctgctggggacctgtgtaatcatttagcccacatcctgggccatgtcagctctcctggaattgtccctactagcgttgagtgtggctgtcttactcccctttgctggaggaacagacctggacttctgccaaactgaggtccctgcctggccaggagctgccattatgattcatggcgcctctgacatcactcagtggttttgtgatgcaaagttcacatgtctgagcacacataagggactctgtgaatatgtgtgtatttgttgtgtgcatgcccgcagaatgggatacagagactcactctattcatcagggatttgttttaatcaggaattggcaggcatgggaagagcacgctgtccagggtcggcaaggcctggaaatgtcagagcatcagaatactgaaaataaaagacatggtcagtactcatacatagacatgacacacacatatacacacatacgcagactcacacatgtcaacagctgaatgaaaaatgtctttcattcctggaagcaggagtcatatcactttctccaaagcatgtctttttctatgcaatggtgtgctttaggtgcaagaacactcgagaagcggcaaagataaagttaaacaaatccaagtgttataattctgcattatgcatatgttttgacttttcatcttttattcagagagtaagataaccaaatagagtaaaggaagcccagccaaccagctcagtttcatgtgggcagaaccagcaggaaattgaaaggggagagaagccccttgccaaagccgcctccacttgcactgggaagcccaccacaggccaccacctgggctgggagatttgtcagcaggcgttggcctgtgacagtcacacttcctgctcctcagtctgagatgccccaaccagatggcggaggcccgatggggaaggagcagcctccacggaggcccgcctggttttccagccttggacttgcagccgggacatgagggctccctcctactctcccacccctcctgctggtgaagcaagcccctcctactcagaagggagctttctctgccctggaagatgcttggaaacttggcttccagacgtgcaggcgccaggggcctgtccactcctcctcccccttctcctggactcactgaccttccttctgtgccacaaacagccaggttcattcccaacccagggaccctgtgtgactgaccattctcctcctggatgctgtccccagccctgtgcatggctgccccttctcacctttcagggctctgccaggtgccacctcctgggctccagggaaacacaagagaattacacagatgtagcctcagaccacacagagctcacatttagtctgaggagtcagaccctaagggaggtaaataagtcactaaacaagacaattccagaaaataataaatgccaacatgaaaagagagcagcctctgcagacagagctgcaagatcctcgaggcctttttaatccccagaaacaaggttcgcaggaggccagagcctttggtggtggggagcggagtcagcagggggaggggagaggcccttcggagagactgagccgccaggccatcgagggaacctgggccagggatgaggcacttcagccctcggagcagctgcgacagcagagtctgacctcccagcaaggggctctggctgcgggcaagctgggtctgacccctggacactgtcccctggagcccctggcctccacgtgtccacccactgccatggtcatggctcctcagcaggaggaggcccagcagcctccaggtgcccctgcctgcggtgccattacctcgaggccttctgtggttgctggagctgccacgctcggcctcctgtctgcctccagatgggagaggaggaaggaggagaatccccagcagctgcctgttctccccctccactgggctagagctgtgtcacacaggctgagcggccaggaagctgggcaccatccagggagtgtgtgatcgtcggggtcctgttgattcctgcttttgagtaatgaaggtgaccaaaccacatgaccctgtctgcaaagattccacctggactcccagttcctccaaggaaccgtcatgtggttcaaatccaatgaaattctctaaatctccaccctcctcagggtgcagagttggctgcttctctgtgccccctgctgatcacggcaacccctgggtgcctcggcctgcgaagccccagctgtcctccgtctgcagacaagccgaggtatgaaagcctcctcgctggcccaggagcctgtcattgtcctccagcagctctagcctggatgcggtcccagagataaatcatatctctttaaaaagccacagtggcccattatttctgcttgaaaatacccctggctctctgctgtttatttcctgtagagcagtttcaccctcttcaccaatcttgtttatttccttgtttattgtgcctcctttaccagaacgttcaccctctgagggcctgggccaggtctgtctgttcacagctctagtgctcagagaagtcactgcataaataaacaaatactttgctcagaaaattgtggatatgtaaatgaaataggtctgaataaatgaattaaatacaaagcatatattttttgttggtatggaaatttgtgcttagaaaaacactgcagatctgtacccaagtgatatgatcgaataaaaataatcttcaaaaaagtcatc

SEQ ID NO: 465630 - DNA, 933 bp, Homo sapiens
ttccccttcatggctgacaatggaaacccacagacaggactggccaggtcgagcggaaggggcagggccattcctctgggctcaggtttccacttggtggaggctggaccgtctcttcccagcgtgggcacacagcgggacctgctgtctctttctgaggggacacagcccccgtcttatgtcctccgggccgcggtggtggggtcaggactgagcatcccccgcgcccacccccacgctcagcccgagtcgaagccttcgagactccccagtgccatctgcacaggacccaggtgccatcgccccaggactctcagaaactcagggcggtccccgagcagctcgcatctcttggggctgagcgtccgcagatgctgtaggcaggaggcgaccggcagttcctgcctccctgagataggggcgggccaggccccccatcaacctctcgctctctggacttgggttgtaaatcgcctcaaggggacagaaaccacccagaaagctgggaggggccccacgagcttacgactgaggtgggataatccgcggagtggtcacccacgtgctcgtggccctggagtccctgtgaccagccctggagacgtcacctcagagggagggggctttgcccgcttccttcaccgctggggccgggacctggatcttgagcacagagtagatctcggtgagatgacatcatcgccattaaagtcaaaagaagtctgtcttttcataaagatacaaatgtctggaggagataattgatttggctaagtgataacatgtgccccatttattaaacaaaatttttcaataaaaaggattttttatgattctctgatataaaatgtgtcataggatacaggaaggttgaattatttttataaactatatacagctcacgacccagctccatggttaacagcaggtccc

SEQ ID NO: 465631 - DNA, 4338 bp, Homo sapiens
gcttttagcagcaccaaccaggactgtgcccattgcgcatgcacaatgagggcttgtgaatcagataccagggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactggcctccctccgtatccagagcacctcaccagcccacttagccctgcccaggaggagctgaaagaagggcaggcccccaagcagcagcaggactcagaggcgagagtggccccagccgggccagaagcaggtggtggtgtggccatcaagacagaggcacagtctgaagacgagatgacgcctgagcggctctttctgggggtgtcccgaggccagaccgagtgtagaatcccccgagggcccaggaacaggcctgggggccccagccgtcatcaggcccagggcatgcccagggtgcgggcaggggagccacggccaccgggggccagtggggagacgccccgagtcctctcccgcaggcggcagcgggcattcccctgccccgactgcgggcagagcttccgcctgaagatcaatctgacgattcatcagcggacccatgtggaggaggggcggcaggaggcccccggccgctcgcccaccagctgcggggacagccaggccatgctggagccgggggaggtggtggtacccggccctgtcatccgctggctccccgaggagcctgagggtcgccgctccgtggcagggggccgtgccttggtggggcggcggcctgcagccagcaagatgtaccactgcagcgagtgcctgcgcttcttccagcagcgcaagagcctgctgctgcaccagcgcctgcacaccggcaatggccagggctggcccgcctgcccctactgcggcaaggccttccgccggccctcggacctcttccggcaccagcgcatccacaccggtgagcggccctaccagtgcccccagtgtggccggaccttcaaccgcaaccaccacctggccgtgcacatgcagacccacgcccgaggccaggtgggcccacacttccctgccgcccccgcccgccacgggagcctgcccctgccctggcccagccggaaggaggagggctgacctggcaggagcccacagaggacccctggcggggtctctcccctgtgcctgacgcaggttcttccttttcctgggatggagagaggtttgttgtttttacccattcaaatgggaagctagctgcccttctggtgacattgtgtgtgaccgggtgctttctgtttcctgtttgcactcttcgctgccttttctgcattcctgacttctaaaagatgccttaaggcttaagggatgccatatttttgataaggcctctggtaggtaccacagccaagaggaccagagatcatggcccttccagtatgggggcgatagagacatcggggacctgggatttttgttttgtgcagagatctcctgcctgctgtcaccatgagaaacagtggagtggagtggatggatggcctgacttgaagaaagggccctggaaagttttctactttgctattttgaaatttttttcccttcttatagagactttgaaatacttttgtaaatgtgtgtagttgttaatggaactttgccttttgcaaagtcggaaagagtcggcttttccatgtgaggctcgcagagctgaaaggggagctacgtccaccagcctgtgggtcttttgggttttttttttgttgttgttgttgtttttttaagatggagtttcactcttgttgcccaggctggagtgcaatggtacaatctccgctcactgcaacctccgcctctcgggttcaggtgattctcctgcctcagcctcctgagtagctgggattacaggcgcccaccaccactcccggctaatttttgtatttttagtagagacagggtttcatcatgttgtccagactggtctcgaactcctgatgttaggtgacccgcacacctcggcctcctgaagtgctgggattacaggcgtgagccaccactcttggcccagcctgtgggttttgatggggatgtcttggctgctgtcttggaggcacagtgtctccccatgtgtgtgtttcttggcccagagtgactcccagtattcctagtccttccccacaggatagtcacatccattatttacttttgttgtcagctgggaggggaaactgaagcctggacacgtctccccaagggctcagtgttcatgggtgtgtaagatccattgactggaccccagaaagcaccctgaggggcagtgcagagagagcccaggaagcccctccactagaggaggcccttggtctggctgaggaccacgtccaccctgggcctccaggcctgcttttcacattaaaggcggggcagtctcctctcaaaggagttctcccttgagcactttgggctctggggcagagttgggctaggagatctgggtgaatcctttagtcacagctagtctcatgttcctcttctgtcaaaggggtcatggccccagtgtgtcctacctcagagttgtcagggtcaaagtaacaggcactgggacaaatatgaagcctagctttgtgcttcctttcaaattcagggcctcctttctactccattccagcctttttttcctgtcagaatccctcaggaaggacctttatcttctggagtgagtggcagttccactgggttcagtgaaagagtcgcccatggggctctgttccccaggagtcctttgtattttggtgaacaaattcttaccaaagcatgagattcggactgtagaagttcagactgcctcagttcagactgcctcatggggcagtctggaggtcagctggcttctggtgtctctcatcacaccactgcggacgctgtctgtagagcagccttggtgtgggtgactctgaagctggagtgatgggaccccagctatccttgttttttaccgccttgtctggcactgtgaccacgcttcagggctgcttctgggggtcttggtccctggatgtgccatttccttgcccttctgaccctcacacttcttccaaagtcttgagcagagttgggggccaatggtagcattgctgtcatctctgggaggagagtgagtatacaagtcagtgacagttcagccaggctcccttgggtttgggaagaggcactgcccttctgtgctgtggatcctgcttgtctgctctggagtccccccacccttgccaggagcttcacaaaccagagacgggctgtcagcaagagctcagacaggatgtggtgcaagtgcaggtgcacgagtttaaccctcagctgcaggagctagtctcaggtgttctggggatgcctcaggctaagaattttgccgactttctgggcttggttggctaatgccaaatgcccctgcttaaatatcacaaggtgctgattctccttttttctttttttcataccaatgtgctcaaactttgagctaggtcttgtgagtttgcctagcactcagacctgtttaagtaacgttctttacattgaaacaagtcaaccgaagctttgtggtgcaggagctgagggtgccccagactcagtgggagccctggttgggccccaaactctcccagcagggtcctcggtttcctcatttgtgaaataaatgagtgggccacgacgttaataagcccaagagaactgtgaaggtggtagtcccttgccctaattggtgctcaataaagttgttggcataaacga

SEQ ID NO: 465632 - DNA, 1070 bp, Homo sapiens
  misc_feature (1070)..(1070): n is a, c, g, or t
gcttttagcagcaccaaccaggactgtgcccattgcgcatgcacaatgagggcttgtgaatcagataccagggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactgattctgtcatgacctgcctggcgatcattaccgtgatttcctgtctgctgaattcctgtgctgcagtttccttctgtgggacatgaggctttagactggaatctagctgccagcctccctccgtatccagagcacctcaccagcccacttagccctgcccaggaggagctgaaagaagggcaggcccccaagcagcagcaggactcagggacgtccaaggatgatgggcactgattctgtcatgacctgcctggcgatcattaccgtgatttcctgtctgctgaattcctgtgctgcagtttccttctgtggacatgaggctttagactggaatctgctgccaattccn

SEQ ID NO: 465633 - DNA, 1040 bp, Homo sapiens
gcttttagcagcaccaaccaggactgtgcccattgcgcatgcacaatgagggcttgtgaatcagataccagggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactggcctccctccgtatccagagcacctcaccagcccacttagccctgcccaggaggagctgaaagaagggcaggcccccaagcagcagcaggactcagaggcgagagtggccccagccgggccagaagcaggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgt

SEQ ID NO: 465634 - DNA, 865 bp, Homo sapiens
gcttttagcagcaccaaccaggactgtgcccattgcgcatgcacaatgagggcttgtgaatcagataccagggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactgattctgtcatgacctgcctggcgatcattaccgtgatttcctgtctgctgaattcctgtgctgcagtttccttctgtgggacatgaggctttagactggaatctagctgccatcacccgtagctgacctacccgtggtcccagc

SEQ ID NO: 465635 - DNA, 1031 bp, Homo sapiens
ggaaaccacctccatgattcaattacttccacctggtctctcccttgacctgtgggaattatgaggaaggcaattcaagatgaaatattgggtggagacacagccaaacatcaccttggggcacaggctcaaaaacagtccacaggataccatcactgagctggaatacaacatggggcatctgaaaagaagaaccaaaatagatgcctggtcttcaactaaattacctgttcatctttttccaggaaaccttggaacaccaaggaatcagcagtcaaacgagctcagtctctcagaacacatgtgggggaattgagtatttcaacttttaggtagacagtttctacaagctaaatagtggaacgaaaggagccaaataaagaagttataaaacacgtgcatatttagcccctactttttattaaactaagactttttattcacatatcaattaattagtttatttattattattcatttattaagggaatgtatggatatctccgcggaaagagaacagcattatcggatgttgtcttcttaaaaatcatccgtctcagtactgagcatattaccacagggaaaggagaggggaagacacatgccacagaatacagtgtgagtcccactaaagtggaagctacatctacctcctggccacctttagatcctcacggcaaaggatccgtgagtgaaaaggcagttgctccactggctggaatgttgaccctaatgaccgtgaagaggccgggtggccagcatcgaggaggctggcaggggaaaggatggcatggaagcctcttcgcacctccatggcctggcagtaactgtttcgggaaaaatatagcaattaaaagacagcaaaaggagataacccaagtgtttagaccttcatcaatcctggtctgggtcttctcaccaggcaatgaaccagacaggccaaagtgagggtaagggaagcctgacatgggtaataaaggggagagaagatgaatgtcccttacgtcttcaagccaaccacattagtgggg

SEQ ID NO: 465636 - DNA, 2298 bp, Homo sapiens
gcattgttcactgtgtgatcgtttacttttaaaatgatgtcacagccccctggtacacacggttctcatctaaatttgcatcttttttaacgctaggataactatgaaagagcatacgattgtgattctgagtttcttactggatttgctttttaaactgcagaatgaaattagttgtttcaagaagtaaagtacaggcatgtcgaagtaaaattcaacaatgggttgttgggcaaaaagattataaaagtcctggggtgtgccagggtcaaaaaaaaaaaaaaaagcttgtccctggggttatcttggcaaaaaagaaaccaccaccacaggttctaaatgcagataagactggcagaaaaatgcagaccaaactattctgcattttgaaagtgaatgtgcctgtgtgacattggaggaatgtaaagaactgtatgtcaagtgtggactttatctcctcaggctagcttagagtggctgctgaacttaagggtgattaagagctgcttgcacctgggtggagctgaaactgcataaggtgaataatacctttgtgcaacagaagaaaaaaaaaaaagcctaatcagggcatggactttggccacatcagtgtcatagagcttcttcacagcctgtttgatctggtgcttggtggctttaacatccacagtgaacacaagtgtgttgttgtcttctatcttcttcatggcagactcagtggtcagaggaaactctgtgacagcatagtgaggcctgaaccttcctctcacctgcccccagacacaggaagatttgggaccaattcagctggacatcgtatggtcgatctcctacctccattatctaggtctcttaaacctgctaccctgtcaccaactcccacacccctaaacatggccttgcctcttactcaatggagaaactgggcaccatcagaaggagctgccacataccctccgactcaccaaagagtctgcttcttacgccagttgcccttcaccatttcccagtgcctctcaccattccccagtgcccttcaccattccccagtgcccctcaccatttcccagtgtccctcaccatttcccagtgcccctcaccatttcccagtgcccttcaccattccccagtgcccttcaccatttcccagtgcccttcaccatttcccagtgcccttcaccatttcccagtgcccttcaccatttcccagtgcccttcaccatttcccagtgcccttcaccatttcccagtgcccttcaccattccccagtgtccctcaccatttcccagtgcctctcaccattccccagtgcccttcaccattccccagtgcctctcaccattccccagtgcccttcaccatttcccagtgcccctcaccattccccagtacccttcaccattccccagtgtccctcaccatttcccagtgcctctcaccatttcccagtgcccttcaccatttcccagtgcccttcaccatttcccagtgcccttcaccattccccagtgtccctcaccatttcccagtgcccttcaccattccccagtgcccttcaccatttcccagtgcccttcaccattccccagtgtccctcaccatttcccagtgcctctcaccattccccagtgcccttcaccattccccagtgcctctcaccatttcccagtgcctctcaccatttcccagtgcccttcaccatttcccagtgctcctcaccatttcccagtgcccctcaccatttcccagtgcccttcaccattccccagtgcccttcaccattccccagtgcccctcaccatttcccagtgcctctcaccattcctcagtgcctgatgccctctcttccctggacatgcacacatattgttatcttggatggccacccttctgtcctgcccaggccctgccagttctcctggatgactctggctcaagctggtgtcatctaaccctttttttggaacctgaaattggggggaaaaggagtaatgacactgctcagtggatgcccataggctgctgcctctcatccctgcagctctggcaacataacaattacctgggaggctctgagaaatgctggtgcccagatgtcactccaggcgaatgcaatcagaaaaggatggcatctgtaccttttagaagtttctcaggtgattctgccaagcggggagcccgagacccacagctttagggaaaagagaaatgacctctttgctcattccttatgatatgatagatttttaacatatatatctaaaagtaaatttatctttacccagggtctgtacagt

SEQ ID NO: 465637 - DNA, 2419 bp, Homo sapiens
aagcgccgccgcgtagcgggaggggcgaccgcggcaggcgctcgggttcttcctaacccgagcccgccgcgctggctccgccgaggacgccagcagctgcaggcagcgcttcagctctcgccgcctcgccatcgttggggcgagtcgtcgccgggtcactcccttattatgaccttcgaatctgacagcagggccagcggtggcctccttcaggctgcctctccagcccttaccaagatggccgcccctgtgggccggggcgccgaagccatcttggtaaaggaagcgcctgggagcacgcggcctgccccggcccgcctcgcgactcaaacactctgcagggaccctcctaagatcaaattggttccccccgctgtcctaagccagaggcttactttcagatcgcatgaacgcattcctggacaccagccacagttgctaaaactaaatgggatcctgcagacccattgacggactgtcatagccaactcaatcacagtcgagaagcatttgaatacttacagcctatggcgctaggatcctggtagcgaagaaactaaactctaatttgaaatgttgtacagctagcttagagtggctgctgaacttaagggtgattaagagctgcttgcacctgggtggagctgaaactgcataaggtgaataatacctttgtgcaacagaagaaaaaaaaaaaagcctaatcagggcatggactttggccacatcagtgtcatagagcttcttcacagcctgtttgatctggtgcttggtggctttaacatccacagtgaacacaagtgtgttgttgtcttctatcttcttcatggcagactcagtggtcagaggaaactctgtgacagcatagtgaggcctgaaccttcctctcacctgcccccagacacaggaagatttgggaccaattcagctggacatcgtatggtcgatctcctacctccattatctaggtctcttaaacctgctaccctgtcaccaactcccacacccctaaacatggccttgcctcttactcaatggagaaactgggcaccatcagaaggagctgccacataccctccgactcaccaaagagtctgcttcttacgccagttgcccttcaccatttcccagtgcctctcaccattccccagtgcccttcaccattccccagtgcccctcaccatttcccagtgtccctcaccatttcccagtgcccctcaccatttcccagtgcccttcaccattccccagtgcccttcaccatttcccagtgcccttcaccatttcccagtgcccttcaccatttcccagtgcccttcaccatttcccagtgcccttcaccatttcccagtgcccttcaccatttcccagtgcccttcaccattccccagtgtccctcaccatttcccagtgcctctcaccattccccagtgcccttcaccattccccagtgcctctcaccattccccagtgcccttcaccatttcccagtgcccctcaccattccccagtacccttcaccattccccagtgtccctcaccatttcccagtgcctctcaccatttcccagtgcccttcaccatttcccagtgcccttcaccatttcccagtgcccttcaccattccccagtgtccctcaccatttcccagtgcccttcaccattccccagtgcccttcaccatttcccagtgcccttcaccattccccagtgtccctcaccatttcccagtgcctctcaccattccccagtgcccttcaccattccccagtgcctctcaccatttcccagtgcctctcaccatttcccagtgcccttcaccatttcccagtgctcctcaccatttcccagtgcccctcaccatttcccagtgcccttcaccattccccagtgcccttcaccattccccagtgcccctcaccatttcccagtgcctctcaccattcctcagtgcctgatgccctctcttccctggacatgcacacatattgttatcttggatggccacccttctgtcctgcccaggccctgccagttctcctggatgactctggctcaagctggtgtcatctaaccctttttttggaacctgaaattggggggaaaaggagtaatgacactgctcagtggatgcccataggctgctgcctctcatccctgcagctctggcaacataacaattacctgggaggctctgagaaatgctggtgcccagatgtcactccaggcgaatgcaatcagaaaaggatggcatctgtaccttttagaagtttctcaggtgattctgccaagcggggagcccgagacccacagctttagggaaaagagaaatgacctctttgctcattccttatgatatgatagatttttaacatatatatctaaaagtaaatttatctttacccagggtctgtacagt

SEQ ID NO: 465638 - DNA, 1030 bp, Homo sapiens
cgagttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtccccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagcatgtttcttctgtaaatatgaaaataaatttcttttttatgtcgtgagatttgtattggcaagaagcagttaatttaaagatgctcttcctatctgtggatgtgttggtaactccgagttgtaatgagttcatgaaatgtgctgttatttttgtaatctcaataaatgtggattgaagttttttccctttttttaaagccaaactaatatttt

SEQ ID NO: 465639 - DNA, 2060 bp, Homo sapiens
cgagttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagtgaagaagagcttatctttactgaaagtaacagtgaggtttctgaggaagtgtatacagaggaggaggaggaggagtcccaggaggaagaggaggaagaagacagtgacgaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccctgacaccacagaagtcaatttgaacaacattgagaacatcacaacacagacccttacccgctttgctgaagccctcaaggacaacactgtggtgaagacgttcagtctggccaacacgcatgccgacgacagtgcagccatggccattgcagagatgctcaaagtcaatgagcacatcaccaacgtaaacgtcgagtccaacttcataacgggaaaggggatcctggccatcatgagagctctccagcacaacacggtgctcacggagctgcgtttccataaccagaggcacatcatgggcagccaggtggaaatggagattgtcaagctgctgaaggagaacacgacgctgctgaggctgggataccattttgaactcccaggaccaagaatgagcatgacgagcattttgacaagaaatatggataaacagaggcaaaaacgtttgcaggagcaaaaacagcaggagggatacgatggaggacccaatcttaggaccaaagtctggcaaagaggaacacctagctcttcaccttatgtatctcccaggcactcaccctggtcatccccaaaactccccaaaaaagtccagactgtgaggagccgtcctctgtctcctgtggccacacccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagcatgtttcttctgtaaatatgaaaataaatttcttttttatgtcgtgagatttgtattggcaagaagcagttaatttaaagatgctcttcctatctgtggatgtgttggtaactccgagttgtaatgagttcatgaaatgtgctgttatttttgtaatctcaataaatgtggattgaagttttttccctttttttaaagccaaactaatatttt

SEQ ID NO: 465640 - DNA, 1430 bp, Homo sapiens
cgagttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagtgaagaagagcttatctttactgaaagtaacagtgaggtttctgaggaagtgtatacagaggaggaggaggaggagtcccaggaggaagaggaggaagaagacagtgacgaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagcatgtttcttctgtaaatatgaaaataaatttcttttttatgtcgtgagatttgtattggcaagaagcagttaatttaaagatgctcttcctatctgtggatgtgttggtaactccgagttgtaatgagttcatgaaatgtgctgttatttttgtaatctcaataaatgtggattgaagttttttccctttttttaaagccaaactaatatttt

SEQ ID NO: 465641 - DNA, 1788 bp, Homo sapiens
cgagttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagtgaagaagagcttatctttactgaaagtaacagtgaggtttctgaggaagtgtatacagaggaggaggaggaggagtcccaggaggaagaggaggaagaagacagtgacgaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccctgacaccacagaagtcaatttgaacaacattgagaacatcacaacacagacccttacccgctttgctgaagccctcaaggacaacactgtggtgaagacgttcagtctggccaacacgcatgccgacgacagtgcagccatggccattgcagagatgctcaaagtcaatgagcacatcaccaacgtaaacgtcgagtccaacttcataacgggaaaggggatcctggccatcatgagagctctccagcacaacacggtgctcacggagctgcgtttccataaccagaggcacatcatgggcagccaggtggaaatggagattgtcaagctgctgaaggagaacacgacgctgctgaggctgggataccattttgaactcccaggaccaagaatgagcatgacgagcattttgacaagaaatatggataaacagaggcaaaaacgtttgcaggagcaaaaacagcaggagggatacgatggaggacccaatcttaggaccaaagtctggcaaagaggaacacctagctcttcaccttatgtatctcccaggcactcaccctggtcatccccaaaactccccaaaaaagtccagactgtgaggagccgtcctctgtctcctgtggccacacctcctcctcctccccctcctcctcctcctccccctccttcttcccaaaggctgccaccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcggattcccaccctggtttaaaaaaaaaaaaaaaaaaaatttggtcagacgctgatttaaagaactaaattata

SEQ ID NO: 465642 - DNA, 2025 bp, Homo sapiens
cgagttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagtgaagaagagcttatctttactgaaagtaacagaggaggagtcccaggaggaagaggaggaagaagacagtgacgaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccctgacaccacagaagtcaatttgaacaacattgagaacatcacaacacagacccttacccgctttgctgaagccctcaaggacaacactgtggtgaagacgttcagtctggccaacacgcatgccgacgacagtgcagccatggccattgcagagatgctcaaagtcaatgagcacatcaccaacgtaaacgtcgagtccaacttcataacgggaaaggggatcctggccatcatgagagctctccagcacaacacggtgctcacggagctgcgtttccataaccagaggcacatcatgggcagccaggtggaaatggagattgtcaagctgctgaaggagaacacgacgctgctgaggctgggataccattttgaactcccaggaccaagaatgagcatgacgagcattttgacaagaaatatggataaacagaggcaaaaacgtttgcaggagcaaaaacagcaggagggatacgatggaggacccaatcttaggaccaaagtctggcaaagaggaacacctagctcttcaccttatgtatctcccaggcactcaccctggtcatccccaaaactccccaaaaaagtccagactgtgaggagccgtcctctgtctcctgtggccacacccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagcatgtttcttctgtaaatatgaaaataaatttcttttttatgtcgtgagatttgtattggcaagaagcagttaatttaaagatgctcttcctatctgtggatgtgttggtaactccgagttgtaatgagttcatgaaatgtgctgttatttttgtaatctcaataaatgtggattgaagttttttccctttttttaaagccaaactaatatttt

SEQ ID NO: 465643 - DNA, 1175 bp, Homo sapiens
cctgaccaatggtttggactgagactaagaacagagctaatctgtgagtgttataatgcacggcaaaaggagaattaaagttgcagatggaattaaagttgctcatcagctgactttaacaagaattatcctggtttatcttatgttaacacaaaggaccttagaagatggaggcagaagcaagagcttcctttcccggagggttggcccatctgctccatggagaggagagtgtgctgactcaggaagccgagccagccaggccctgagcggtgcctctgccaggacgctggcccacgcggccactgcacaaatgacagcatgtgcgttccagggtgcttggcagactctctcagtgaaggagcttcggcatgaaaaagtccccatcaggcggatcccacgccctctgcacagcttgtgtaagggcacagcttgtgtaaggacaaaaactaaccagacacctactatgtagaaggctcttcaatgattcttctttgagtgttctttacacaaagaacactttgtctcttgaggcgaaatgatgtatccagctagcgccatcgaagacatttggaaaactcaggtttcttcatggcttgcaagattacctagcatctggaagaggctctgggagggtccaaacaacaaaccacgcggcgttctctggtggctgtgctgggacgagtgggcggaaacagccgcaggtctctctcttctcttcagcctgaaactcactgcacaaataccagaggttttttttagagattagataaatttgcatccttctccccccaaccccgcccctaagccagaggaagtgcttgaggaagtaatgtgtttaaagaatgtgggggaggggagcttacattaggaagcaggactcttagcgtgtagccagaaaccccaataacctttaagctgttaacccttgaggatacggctcaatggtgtacccacgtggagttcattatttatctccgaaagccctgtctgtctctcattccgacccttaaacgaatcatctgcagtttggccaacaattcagttccagctccctgggaataccagcaaatcccgggacagctgttccttctgctgaaaacaccaggaaaatccgcccaggagctcaggctgtttgaccagaaagcctggtgttggtcactgtcagagagcac

SEQ ID NO: 465644 - DNA, 3351 bp, Homo sapiens
  misc_feature (6)..(7): n is a, c, g, or t
  misc_feature (9)..(9): n is a, c, g, or t
agatcnntngaggcttattcacagtcacgagaacagcatgggaaggacctgcctccgtgattcagttacctcccactgggtccttctcacaaaacatgggaattcaagtatcttgagacttgatgaactagataaagagactaaaggagataagccagctgagaatagagcattggaaaagactgaattcggtgaacaagaggaggagacaaaaaggaggcagcaagagagtgaagatattcgaatccagcttgtgaaagatgctagaagatttgatggggtggatgctgaatttaagaagagaaaaattctgtgtgggcctaaagtggtgacagtgcttatcacatttatttttataaaaacggtgtgcttctacattgcttttgatcttcatctaagagttgaaaagcaaaatttagaaaagattgttctaatatccacggccccgtattgtactttcatgcaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatcaagtgttgaatacctactatgcatcagatgctaggtcaggctttggggagttccgaaatggcccttgtcttcgaggagctcttaggcccattgagaaaatggatatgcacataataatggaggttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacagtggggctcctgctggcccagctggtaccgggaaaacagagaccaccaaagacctaggacgtgcccttggcatgatggtctatgtattcaactgttcagagcaaatggactacaaatccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagagatttgtatttcttggggaagctatcacactgaagccatcagttggaatatttattactatgaacccgggttatgctggtcgaaccgaattaccggaaaatctcaaagctcttttcaggcaagaatttttaaaaatctatgccatgagggttattgttctacactgtccttgtaaaatttttgtctggctttggcatcagagtagtgctgacatcatgaaaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagttgtccagcttgaggaactgttggctgtgcggcactcggtctttgtagttggaaatgcaggcacaggaaagagtaagattttgagaacactgaaccgaacatatgttaacatgaaacagaagccggtttggaatgacttaaaccctaaagctgtgacaacagatgaactctttggtttcatacatcatgctacccgagaatggaaagatggcaagtacgttaccttctataaatccccacaactgttcatgaaggaaggtttttgttatctctgtttggcatatgggaagctcagtctcttctcatccattctacgagaacaagcaaatcttaagcatgatggaccaaaatggatagtcctggatggcgatattgaccccatgtggattgaatcactgaatactgtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcaggagtcactgggccaggtcatcctgtggatgcatagaggtatcactggaccaggtcatcatgtggatatggcagtgactggaccagatcatcctagggatataggagtctctgggccagattatcctatggatataggagtcactgggccagatcatcctgtggacatgggcatcactgggacaggtcatcctgtagacatgggcatcactgggccaggtcatcctatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcagtatcaactctaagtcccaaatataatccaaatatcatctacatgatacatttcatctatcagttcatttcatgaattgaggtacaattcatcctgaggcaaaattcctctctagctgtgaacttacaaaaccagagaagttacctgcttgcaaaatacagtggtagaacaggcataggatagacctttctattccaaaagggagaaatcagaagaaagggg

SEQ ID NO: 465645 - DNA, 2803 bp, Homo sapiens
gcggccgcgctgcctccaggaagcctcacgggccttcgtctgccgggccgcggcgccggctcccaggatgcagtgtggaccggccgggcgctgacggaggcggcgcgactgcgggcggcgcggcgcaggggcagccagcgaggagcggcggcagaggaaaggccaggcaggcgccgcctgcggagagcaccgggcggccgggcctgcgtggtgccgcgcgcggcggcggcgacgacgacttcctccgggccgggcgggacagcgcagggccatggccgaggcggtcgcggctccgatttctccgtggacgatggcagccacgattcaggccatggagaggaagattgaatcgcaggctgctcgcctgctttccctagaaggtcgaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcgcaacaggaacttctggatcctgcggctgcccccgggcagcaagggggagtcccctaaggtgcccgtgacctttgatgatgtggccgtgtatttctccgagcaggagtggggcaagctggaggactggcagaaggagctctacaagcacgtgatgaggggcaactacgagacgctggtctccctggactacgccatctccaagcccgaggtcctctcccagattgaacaagggaaggagccctgcaactggcgccgccctggccccaagattccagatgttcctgtggaccccagtccaggctcggggcccccagttcccgccccagacctcttgatgcagatcaagcaggagggtgagctccagctccaggagcagcaggccctgggcgtggaggcgtgggcagccgggcagccagatattggggaggagccctggggcctcagccagctggattccggagcaggagacatctccacggatgccacctctgcatgctcggacgggaccctgaagctcaacacagcagcctccacggaagatgtaaaaattgtaataaaaacagaagtccaggaagaggaggtggtggccacacccgtacatcctactgacctagaggctcacgggaccctgtttggaccaggccaagccacacggttcttccctagtcctgcccaggaaggagcctgggaaagccagggcagctccttccccagccaggaccctgtgctggggctgcgagagcccgcccggcctgagagggacatgggtgagctcagtcctgctgtggcccaggaggagacccctcctggggactggctcttcggaggggtccggtggggctggaatttccggtgtaaaccgccagtgggcctgaacccgaggacggggcccgaggggcttccttactcctccccggacaacggagaggccatcttggaccccagccaggccccaaggccattcaacgaaccctgtaaataccctggccggaccaaaggctttggccacaagccagggctgaagaagcaccccgcggcgccccccgggggccggcccttcacctgcgccaccgcagctgtggggcgcccgacgggtcgggcccgggcacaggcggtggcggcagcggcagtggcggcggcggtggcggcagcggtgggggcagcgcacgggatggcagcgcccttcggtgtggggagtgcggccgttgcttcacgcgccccgcgcacctcatccgccatcgcatgctgcacaccggcgagcggcccttcccctgcaccgagtgtgagaagcgcttcaccgaacgctccaagctcatcgaccactaccgaacgcacacgggcgtgcggcccttcacctgcaccatccaaatttaacgacgtctgcaaagtcccttttgctatataaggttaacacattcaccggttctggggactaggatgtggacatcctgggtgggggggggcgggtgcattattcaacttaccacacctcccaagagtcagggcaaccctcattgcttctctgaggccaggccaaatactccctgggacattcatatatgttctggtactgaaataacttgtgccaaaatgagaacatttgaggttcatcattccagccattccctcatcttggccaccctctgttgcccatcaaaaggtgctcatttgctgttacctcctcttgtcatcttttccttcatctttttacagttttgttctcttattcctgatgcttctgaagatggccccctccctccaactctttccattgttaggttgcaatgctgcatcattgtcatgttcacaggcagattgaagacaagatgagttaagctgcactttaaccatctcagtagcatcaagatctttgaagattgccctgaccacttctataaaatgaagtttctaattttgttgtaattgtcaagtttcttttagcccagagttgtacaattgtacctgattatttaaaaacattaaaaatacagtttagacatgaaatacatacacttaaataattatgttttataaaaaatttggtcaaagagtcataaatgcaaatattatggattgtatgacccaattacatctggaagttccagataggacctaataaacataactttaaatatagagctaagatagaatgaaataaaaggaaactccagtgtgccccaaatgaaggcaaaactgtacccccaagttgtcagcacatgggtcgctgctgggcctacctggagtggggtgaggagaaggatatgta

SEQ ID NO: 465646 - DNA, 511 bp, Homo sapiens
tgaacagcagttgaagagatctactaaaatgtgcatattttctaatgttctcttcagacgcgtccacagaagtgataagaaaaaaaaaggacattgcagagggcaaagccaagaggtttggagagtggtggataaggagctactccaggaagcagaacaaggactaagtcagcaggaacagccctcaaccagtgaccgatgggtgaatgaacacagcagctcaagtgggacagccttgagcatgggcaacaggataagaccctgtcgcaaagaaagagttggacttaaagataaacatgatttggatggatgcagagtgggcaacaggaataaagacatggatgtactatcaattttccatgcaaggtgggtcctcaggaacgcagatcagatctatgaaaaccacaggataatgcagtgccctggggcaagtagtaacagggctttgttaccattgtgttacgggttaaattgtgtccctccaaaagacatgttgaagttgtaaccttcc

SEQ ID NO: 465647 - DNA, 2698 bp, Homo sapiens
tggaagtacatgatcaaacaggtcttcatcctcatccttttcatgggcagggttatttttggttcatctatttcatcatttcatttaatttcctcatttcatttcatcctttcatcatttcgttgcatcatttcatttcatcatttcatctcatcatttcatttcattctttcatcatttcatctcaacatttcatttcatcatttcacttcatctcatcatttcatcatttcatctcatgatttcatttcatctcatttcatcttttcatctcatttcatcttttcatctcatttcattatttcatcctttcatcattttgttgcatcatttcatctcatcatttcatttcattctttcatttcatttcatcctttcatttcatttcatcatttcatctcaacatttcatcatttcacttcatctcatcatttcatttcatctcattttatttcatcttttcgtcatttcatttcatcattgcatcttttcatctcaattcatttttcatcaattcatttcatttcacttatttcatcatttcatcatttcacttcatttcatttaatatcatttcatcatttcatatcatttcatcatttcatctttccatttcatcatttcatcatttgacttatcatttcatttcatcatttcatttcctcatttcatcatttcatttcattgcatcctttcatcatttcatctcatttcatcctttcatttcattatttcatttcatcatttcatctcatcattgcatttcctcatttcatcatttcacttcatctcatttcataatttcatctcatgatttcatttcatctcatttcatcttttcatctcatttcatcatttcatcttttcatctcatcatttcatcaattcatcatttcatcatttcgttaatcatttcacttcatttcatcatttcatatcatttcttcatttcatcatttgatcttttcatttcatttcatcatttcacttcatcatttcatttcttcatttcatttcctcatttcatttcaccatttcatcatttcatttcatcattccatttcatcatttcatcatttcatttcatctcatcatttcattatttcatcaattcatttcatttacttcatcatttcatcatttgacttcatttcatcatttcatcatttaatatcatttcatcatttcatttcatatcatttcatcatttcatctttccatttcatcatttcatcatttgacttatcatttcatttcatcacttcatcatttcatttcatcctttcatcatttcatctcatttcatcctttcatttcattatttcatttcatttcatctcatcattgcatttcctcatttcatcatttcacttcatctcatcatttcataatttcatctcatgatttcatttcatctcatgatttcatttcatctcatttcatttcatcttttcatctcatttcatcatttcatcttttcatctcatcatttcatttcatcaattcatcatttcattatttcattaatcatttcacttcttcatttcatatcatttcttcatttcatcatttgatcttttcatttcatcatttcatttcatttcatcatttcacttcatttcatttcttcatttcatttcctcatttcatttcaccatttcatcatttcatttcatcattccatttcatcatttcatctcatcatttcatcctttcatttcattatttcatttcatcatttcatctcatcatttcatcatttcacttcatctcatcatttcatctcatgatttcatctcatcatttcatctcatgatttcatttcatctcatcaattcatagcatcttttcatctcatttatttcatttcatcttttcatttcgtcattcatttcatcatttcgtcaattcatttcatttccttatttcatcatttcattatttcacttcatttcatcatttcattccatcatttcatatcatttcttcatcatttcatcatttcatttcacttcatttcaccatttcatcatcattccatttctcatttcatcttatcatttcatttcatcatttcacttcatctcatgatttcatcatttcatctcatgatttcatttcatctcatcatttcatcttttcatctcatttcatttaatcatttcgtttcaccttttaatctcgtcatttcatttcatcatttcatgtcatcaattcatcatttcatttcattatttcctcatttcatcatttcacttcatcacttcattacatttcatctcatcatttcatatcatttgttcatttcatcatttcatcttttcatttcattgtttcacttcatcatttcatcatttcatatcatttcttcatttcatcatttcatcttttcttttcatcatttcatttcattatttcacttcatcagttcatttcatcatttcatttcatttcctcatttcatttcaccattttgtttcatcatttcattatttcatttcatcattcgatttcatcatttcatttcatcattttatcatttcatttcatctcatcatttcatcatttcatcatttcatttcattccatcatctcatcatttcggttcttcatttgatcatttcatttcatcatttcatttcatttcagtgatacatgtatttaagtgcttgcgatgcccaggagacaccctttttcc

SEQ ID NO: 465648 - DNA, 1176 bp, Homo sapiens
ctctggtaagttctcagcgaaatccacagccttttccttcatcttccggactctcaatgtgactgattaaacttacaacatgctctgcagggggaaacgctttagcatgtccgcctctgtggcgtcgccgaaggcacccccaccttcacgcggagcccatcggaactcgaggcggggctgctgggtcttccaggagcgcccagacgcgggcaggtggccgccggtggccacaggcctgggcaggatggaagcgcccgcagagcgggcgcttccacgtctgcaggctctggctcggccgccgccacccataagctacgaggaggagctttacgactgcctggactactactacctgcgcgacttcccggcctgcggggcagggcgcagcaagggccggactcggcgcgagcaggcgctgcgcaccaactggcctgcacctggcgggcacgagcgcaaggtcgcgcagaagctcctcaatggccagcgcaagcgccgccagcgccagctgcatcccaagatgcgcactcgcctcacctgagcctgggataccgaaggacctgttcgaagtatttactgtaactccaactgtaacttggttctgaggaggagagaatccatgtttggtcaacagaacttttcgctgtcacttaagtttactgcttcgatatcttttccttactaattgattgttaattaagtagtgcccaagtggattagcctttttagagtttattaattaaaagagagcagcaagaatggcattttaactctcccgggttttttttcagttactatggtaactcttttcaagtccacaaatgatttgttcttatctgtaaagaaaaggtcacaaagataagcggagagagaccaaagataggaatatgtgtaagatttctacctaaatgtcggccgggcactgtagctcactcctgtaatcccagcactttgggaggccgaggtgggcagatcacctgaggtcaggagtttgagaccaacttggcaaacatggcaaaaccccatctctactaaaaatacaaaaattagccggacatgatggaatgaatgacttagccacgtttgagtaaaatggtgcctgttctggtctggattcctttctgtcttgaactgtccaaagttctcctcgctctaaacccttcttgtgccagaatgtat

SEQ ID NO: 465649 - DNA, 945 bp, Homo sapiens
ctgggtgacactttccatctcaacgaggcatcatttgcaagtgatgtgctgccatcatgcaggaccgaggccctgtgtgaccccaataagagcagttgttatatcacattgcagagcactgcttatgcctccatcatctgcaataaactgtaagttccccgaggacagaaatacattttataaagctatagctgccatagatagtgattcctccgatggatgtgtgcaaagtaaactgaataccttctggaaaagattcaccattcttcatgccattaagaacattcaaaaagattataacttgctgaaggctcagatgggaggatcccttgaccccggagatggaggacgtcgcatagatattaaagtccgtgctgtctacgggaaatttcatgatgcttatcacagaaatctctaccaggataaaatgatagctgatgccagagagaaggagagacagcctcctcctacctgcaagcaagagtgtgagagcttgtcatcaaggagctttgcaatcatatttgcaggtggagttgcagtattttcccggaccggggtagcttctggccttcacagcccaaatgccctccccttttcgactgaagaaagaaaaggacgaatcccttcaaacacgatctctttcatgagctctttgatagactctttttctcctcctctgcgccaaaatgaatccaacagaatttccgtggctccctctccttaccctgaccccatgttaattgttgcaacaaacgttgcaactccagtgtgagccagaagacatggatgtcatcgggggtccccagtgtctgaggaaaggagaggggaaggatgacccgtcacggttcagaagacagagacaagcctgcaagtgtgcaaagagggaaaagactgcaggaaattccacttgaaatgggccataaaagtgcatcttttgtaatattt

SEQ ID NO: 465650 - DNA, 4294 bp, Homo sapiens
ctcctcaagtgccaccaaagtaggagcccaggcagaggaggcgctgagagcaagcgagggctgtgaggactgccagcacgctgtcacctctcaataagtttccatgacctccctaattcctcaggtttctgaacttgtactgaatgtgaccatttcgacactgacatttctgcagcaacatggagtagcagtcaccgagccagtttaccacctgtccatgcagaatatagtgtgggatccacagaaagtccagtatgatctcaaatcccagtttggctttgatgatcttcacacggaacagatcctgaactcttcagctgaactgaaggagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgctgtcccctctctctatgttctgttcaaagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatgttctttctggttcctgcccacgtccctgcagtacgggtggctgaggtgtgggagctcttcacccaggctctagcagatagcgtggattttggcaaggcgaggactcacagaggtgcctctgcgccttccagcaaggactcacccttcaatgtcgcacgttgttgtgaatgtgaagtattacagcatctgtggaaattgcaaagcttgctgcaaaacctgccccagtggccggcactgaagagatttcttcagcttgatggagctctcagaaatgcgatagctcagaatttacattttgtccaagaagtcctcatttgcctggagacatcagctaatgattttaaatggtttgaacttaaccaattgaaactggaaaaggatgtgttcttttgggagctgaaacagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgatatttcatacacttgaaaaaacacaatttttcctggaacaagcatattattggaaagccttcaaaaagtttatcaggaagacttgcgaagtggcccaatatgtaaatatgcaagagagtttccagaacagactattggtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgagtgttgttgagatttgtgaagttttccagcagactgtgaagccctcagaagccatggagatgctgcagaaagtgaagatgatggtcgtacgtgtgctcaccatcgttgcagaaaacccttcctggaccaaggacattttgtgtgctactctgagttgcaagcaaaatgggataaggcatctcattttatctgctatacaaggggtcactttggcgcaggaccacttccaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgttggccaaaagcctcgaggaaacttggtcatcagggaatcccatcatgacttttctcagcaatttcacagtaactgaggatgtaaaaataaaagatttgatgaagaatatcaccaagttgactgaggagcttcgctcttccatccaaatctcgaatgagactatccatagcattctagaagcaaatatttcccactccaagtatgaatcattatgatcgcctaaacagctggacagttaagtaattgggaggagtatttaaaaagttgcattcttgcgtttcaaataagtaatgagattatttgctttgatggttaagtatatccataaatgcacatgtatctacagatcctaggcaaggaattaacattaggttaggaggtgacactttggatacttgttttttctagattgtcaggttttt

SEQ ID NO: 465651 - DNA, 1317 bp, Homo sapiens
gcactcttctaaggtgtcaaggtcatgaaaaacaagactggaaaaccaacacagactggaggagactaagaagacctgacaactaaatgccatgtgggaccctggaggggacccgggaacagtagtagaagagctggtgacatctgaatgaagtctgtaatttggaagaggacaccaggcccagagagaggaagagactccctgggacagcatgcgcagccagtggcaaagccaggacccacatgccgatccccccttccccgcagccctccctgtgtggcagggttggtaccgatgcgataccacagccacagccctcccaacatcaacccactgggccgcctgtgggcctctgctcttcaaaggaagaaagagctatttgggataatggttcgcagagccctctgaagttccaaagagttggaaaaaatacatctataagacccatattaatgagtctctccctgttcatttcaagcccagaacattttttggatttaaataatgcacgactgaatatggatgggatcagtgactcagagcagcggggcggagatgtgggattgttaataaattatagcccttgggccagagtggggtgtaaaaggaaacagaagaaggacagaagacaagataaatgagccttcagatgggaagggatagggctgggagcaggaagaggctgccctggacatgggcagagcctacagctcctatcccggtgtgagccgggacaggatgaccagatggcaccaagaagggtaaggggaggaactgggcatgcccaagatgttcagacctccaggacctgatccaatgtgaggatgtatggacccttcagtcatctatagggagcccacacgcaggaagttccctgaggctgatccatgaagctcagctcctgggagatggttttccctaaagggactgtggggtgatatgcatgtgcaaagcagcacacaccacgtgggcctcttggcacactcatatttaaaggatcagagaattcctgctgtatcaacctggcttgcgccacttcccaaagctacctgaccacagaaccacttcctcacagacctggccttggaagatacagctggggaccataccctggccctccttcctgtcctcaggtggcagctgctcctgaaatgacatcatgttttcctcttctatggtagctctaggtactggggttccaggagccttactaagtacttaagcagttcaacttgtttggtataaacttgggccaccccaagcacccaaagtgaaaagtctagatttctggtgaggatgcagatgtgaattccattt

SEQ ID NO: 465652 - DNA, 3465 bp, Homo sapiens
cacagaggtggagaactccaactcatctggatgaatctccaaccccaaatatttaaacaagcatgttcaggcccttcccccaaccctgggtagacttgagccttgctcctcccacagcgtcttggggacacaagaggaagtgctgcggcttccctggtgggacattgtgctctctctccctctcggagggcccctccctctgcactttcagcgatttcaagatccgcacattactctttatcaacttggcagatgctattgcctcttccggctcacaagcttccgtgctgggctcctcttgtctgcttcctctcctgctaagatcccaacaccagcaactcacccagggccggccgaggctcaggctgcaaactgcactacccagttctgagaggatagaaaactatagcagctggttcatcaggcttgatgacccacagcagagcattagcattcagaatggttgaaacagaagttgatctggatttattaaaatgtcagtttcttgatatagtggtctcttcaacaaagtcttaattgctagcctcccaccaatttggaaaacacacatacacatacacacacacacacacacacagtttattcatacctttaaactactctgcttgcccttaaagttctccattcattcaacctcctaactgtgaaattcaaatgactcccatcgggccctaatggccctggtcccagatcaccaaaacagtaaatgtgatggttagtattcagtgtcgacttgattagattgaataatgcaaagtattgttcctggcttgcagacggtttattgtgggggacttcaccttgtggtcgtgtgagtcaattctcctcttcatatatccatatatcctattagttatgtccctttacagaaccctaatacaggaaccctctaggaaacactgctcctggtggacatctttcctctccctgcctctattcatctttccatcaatattgattaggtgcctgtttacatggtaggcatgggaagtataaagatgtgtaatagacaaacgaagccatcattctcctttcattcaaaattcacttcagaagctaagcccaagcttagacagcagtaagcacgtgggctttaattctagttcttcctttgacccctccactgcctcctctcagtggacctcaagcaattaaatcagcctcaatgccttggtttctctattcataaacagggacaggagtaaaatagaagatccttattttttccttcacaaccttgaagagaagcatattcatttgtctataggagcatactcatttgcatccctctaggaactcacagaaaaccaggtggcattattaaacataccagtgaaagatacttcaaaattcagagaatgtctttctattttgtatattaatgctttggtaaatctaccctagagattgtataataatatctcattttaaagtaaactgaatgcattattctagtttaatgcaatcaaatatttaggtatatatgtgacttgtttttcccatctcatactttgaaaaagagctttcaataaagattccaaaacaggttgcgtttttccccctagaattttcattgtctaataattattatatcgctcaaagcatgagttatatcaagactttatggatttttctgagtggcagtgtgctgtgccagatagagcattagactgaaaatcatgagacctggattctaggtataatattgctatttactaattctttatctttttagttaaaattctcttggtaaccagtaatggaaaccagctctaaatgatctttgttttttatgaaaaatttattggaaggcccctgctgtatgaaattgaagaaagagttggacaaccaagacacgtgaagagagagcatgagactggctccagcactcagcattaggagagcatggacttccttccaattgtgccacctttcacagacctaccctcaagaaaccttcagcctgagtccctgtgtcaaatgtcaaactcttgagaaagagactgataagctcagctcgaggccaggagagagaacctgctatctctggggtccagaacagaagagatgatggcaatgcaccttgcaggtgcagtttccttggggacccctgaacaaggaggttgttatctggccatcttcattcccaccttgtgggaactgggtccagggaaccaacacaaataagctgacaacttggctactgcttttgctgcagggatgcatttcacagagcacatgagcaactcggagggacctgggaagccatgtggctgatgccttgctttacagaagaggacaccaggcccagagagaggaagagactccctgggacagcatgcgcagccagtggcaaagccaggacccacatgccgatccccccttccccgcagccctccctgtgtggcagggttggtaccgatgcgataccacagccacagccctcccaacatcaacccactgggccgcctgtgggcctctgctcttcaaaggaagaaagagctatttgggataatggttcgcagagccctctgaagttccaaagagttggaaaaaatacatctataagacccatattaatgagtctctccctgttcatttcaagcccagaacattttttggatttaaataatgcacgactgaatatggatgggatcagtgactcagagcagcggggcggagatgtgggattgttaataaattatagcccttgggccagagtggggtgtaaaaggaaacagaagaaggacagaagacaagataaatgagccttcagatgggaagggatagggctgggagcaggaagaggctgccctggacatgggcagagcctacagctcctatcccggtgtgagccgggacaggatgaccagatggcaccaagaagggtaaggggaggaactgggcatgcccaagatgttcagacctccaggacctgatccaatgtgaggatgtatggacccttcagtcatctatagggagcccacacgcaggaagttccctgaggctgatccatgaagctcagctcctgggagatggttttccctaaagggactgtggggtgatatgcatgtgcaaagcagcacacaccacgtgggcctcttggcacactcatatttaaaggatcagagaattcctgctgtatcaacctggcttgcgccacttcccaaagctacctgaccacagaaccacttcctcacagacctggccttggaagatacagctggggaccataccctggccctccttcctgtcctcaggtggcagctgctcctgaaatgacatcatgttttcctcttctatggtagctctaggtactggggttccaggagccttactaagtacttaagcagttcaacttgtttggtataaacttgggccaccccaagcacccaaagtgaaaagtctagatttctggtgaggatgcagatgtgaattccattt

SEQ ID NO: 465653 - DNA, 1520 bp, Homo sapiens
agcatctctgttctctcatttaagtgtctgctgattccccccttagatctgccctggagactggtagtaatgcaggaacagtctgcagggattctctcttgctgcctcagtctaccagccacagtctctgcacgtttccaagagcagcagaaaatgaacacattgcaggtctgcagactcgtgaatgacgtctaccgcgtgtataatcgacaccagtatccatttgttgttcttaacatttctgttgattcagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatctaaacgaataaagcagttacatcatgaagcacagcaaagtgaaggggaacagaattacaggaagtttagggcaaggatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgctccagtcactgaaagggctaaactgatttccttgccaactagtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagc

SEQ ID NO: 465654 - DNA, 3886 bp, Homo sapiens
tgactcactgccatgtcacacgtccccaggatgtgctgtgcctttgctgggacctacagttctgttgggagtctctttggtgtcatggtcccaactgaggctgtgagaggaaagatgtcctatgacacctgctgccctcagggcctcttcctctttcccttagacgcaggccagctggaacgtccccaggcgttctgtcctggatcaagcaagaggaaggggcaagtgggaggagccagcagggcccacaggagaccactgtggcacacctgtgctcaggtaaggcatgctgggccatgtctcctcaggcctgtatccctgggccttaggagacatggcgtcccctggggggcctcacagcgcctctagtggggccttctcctgggcgaggctcctgagggaaggcagtgcgcagccttggctgtgtctctgcagaatcttgtatgcttgctgcgtggtgtcctcccatgcagttgcacgaaatcattcttttattcctgatcctgtttcctgtttatttcatgaacttgtctgtaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggtgagagcttcacctgtccctcctggcttgtgcgtcaccaggacagccatgctagccaggcctctccatcttgcctggtttgtgagagggactcctcgaccgatgagccgcccacgggcctcaggggtgcagtgtgggggagcacccctagtaatccttctgccgcactcagatttgagggcactggtacagagctgggcctcaggaggtgccctggggacaggcagcggggcagtggtgatcaggaaggtcttgggtgggggtcccttgcccagttctctttctcgcgtgaagatggagaatgtgggtagcacccagagagctccctaaaggggctctgagggcccaggggcagttggtgccccttaaatctgagcaacctctcctgggggccacttcttggccaggtcaaagtattctggccatggtcttggcttcccgggggagggctgttctcccaggcactgagattgcccatgggccttctcgttgcagggaggcggctgggatagaggccagtcccaaacacctgagcctcactgaggggaaggcctgggcttggagatggggtgcgcaggagtggctggctttgccttgttctattaggcgagtgattttcagagacaaaggtccaagttaggagacgtaattactcagtgctttgaagggacatccaaggtgctcactcttagccatagccgttggtttcctggatgctgactgtgaagattctaaagtgcttcctagggtgggcggtggtggcaggaggccttggacggagtccaggccagacccagcctcctgtttaataggctgagcccaagcgtccctcagatgcgaatccaacagccttggtgagttgtaagatttcatggaaactttccctgacttctgtctcccccttgctccccattacctgggaaaggcagctttgtgggccatgtgtcccggaagggcctgggctggctgtggcccagtgctcaggaccagccatcttggccctcacagcgccctgcccagttggtgtaatatttgtcttcaagccattgttggagcaggcaggcaaagggggctttctgaggatccaacgtgtgccagccactgggatacaaagacaggcctggttcctagctgtggggctgggaagggtatctgacatcaatggtggcacctggcagaggacacacagacaacagcaggcagcatgggctgcagtaaatgttgcagaagcacctaaaggttgagcagaagggaggtaggaaacctggacatggcctgccagcagctgagaagcccccctgagatcctggcggccccgccaccatctgaagatttaggccagtcccttgggcttttcaggcaggcccttatggtggccggccagtttgggaccctcccattttgatacattagttccccctcagctactggagatctcagccacaactgggctccagctgtgacccagactccgccaggatcccctagatcctcagctgtcagataatcccctgtccccctcctcctccccactcaacccccagtgcttgacatgaatgcatgtgtgcttcctaggactagaggccggtgctgtctctaccattgccctcactttaaggggcacacgagcagatggtagcaagccctggagagcagcactcgggcaagtgaggtggctctggcactgcccctggactttcatgtttgtagcttgagctggttttaattggaagctctgtgatttacataatcacttacaatctctgtaaataaggaactatttatgaggaattgtaaatttcctctctcccccttcttaccctgtctgtgatcttgtctgtgatgcagtaatgatattccactctaggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtgatgccattctcaattttaatgtcattgatctgataatgcaaattttaacagcacatctttaccacttcctgccttaaataatagttgttaatacatttccagtatttcattgaatctaagatccattgattgtaagacacacccttattttctacttcact

SEQ ID NO: 465655 - DNA, 4610 bp, Homo sapiens
tgtccgctgcagtctgctggagccagagtctggctcctggctgtgaggtggtggagaagaagatggaaccccaggctgcctggctacagagcctggagggatgcatgtggacagccaagaagaagctggctgactgcgagaaggtggctgtggagttcgggaaccagctggaggcaagtgggccgtgctggggaccctgctgcaggagtacgggctgctgcagaggtggctggggaacgtggagaacctgctgtgcaacaggaacttctggatcctgcagttgcccccgggcagcaagggggaggcccccaagaaaagggtcccagtgtgctgtgggaggcagggtgaggaggctgtccggcctcaggcgaggaaggagaagcacgtggaaggaagggcagcaggaagcctgagcctgactgccatggatggccagacccactcttgggcctcagtttcctcatctgtctggactaggtgacttgtctatgtgggcagtggatgggaacccttcctcttggcctcatggcactcacttctagcccacgaaaactgagaggccttgcccaccctactctccatgcccctcaacacacgccttgaagaggctgctccaagcctagcagaacaccctccctttccaggcctgcagaggacagccctgccactgcccttttcctccccacaggccaggccaccaccaagccagatctggcaccagtggagaaaggagacaggcaggcaactgcagcctgcccagtgcggagaggggccagagcccgggcactgggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggtaaggcatgctgggccatgtctcctcaggcctgtatccctgggccttaggagacatggcgtcccctggggggcctcacagcgcctctagtggggccttctcctgggcgaggctcctgagggaaggcagtgcgcagccttggctgtgtctctgcagaatcttgtatgcttgctgcgtggtgtcctcccatgcagttgcacgaaatcattcttttattcctgatcctgtttcctgtttatttcatgaacttgtctgtaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggtgagagcttcacctgtccctcctggcttgtgcgtcaccaggacagccatgctagccaggcctctccatcttgcctggtttgtgagagggactcctcgaccgatgagccgcccacgggcctcaggggtgcagtgtgggggagcacccctagtaatccttctgccgcactcagatttgagggcactggtacagagctgggcctcaggaggtgccctggggacaggcagcggggcagtggtgatcaggaaggtcttgggtgggggtcccttgcccagttctctttctcgcgtgaagatggagaatgtgggtagcacccagagagctccctaaaggggctctgagggcccaggggcagttggtgccccttaaatctgagcaacctctcctgggggccacttcttggccaggtcaaagtattctggccatggtcttggcttcccgggggagggctgttctcccaggcactgagattgcccatgggccttctcgttgcagggaggcggctgggatagaggccagtcccaaacacctgagcctcactgaggggaaggcctgggcttggagatggggtgcgcaggagtggctggctttgccttgttctattaggcgagtgattttcagagacaaaggtccaagttaggagacgtaattactcagtgctttgaagggacatccaaggtgctcactcttagccatagccgttggtttcctggatgctgactgtgaagattctaaagtgcttcctagggtgggcggtggtggcaggaggccttggacggagtccaggccagacccagcctcctgtttaataggctgagcccaagcgtccctcagatgcgaatccaacagccttggtgagttgtaagatttcatggaaactttccctgacttctgtctcccccttgctccccattacctgggaaaggcagctttgtgggccatgtgtcccggaagggcctgggctggctgtggcccagtgctcaggaccagccatcttggccctcacagcgccctgcccagttggtgtaatatttgtcttcaagccattgttggagcaggcaggcaaagggggctttctgaggatccaacgtgtgccagccactgggatacaaagacaggcctggttcctagctgtggggctgggaagggtatctgacatcaatggtggcacctggcagaggacacacagacaacagcaggcagcatgggctgcagtaaatgttgcagaagcacctaaaggttgagcagaagggaggtaggaaacctggacatggcctgccagcagctgagaagcccccctgagatcctggcggccccgccaccatctgaagatttaggccagtcccttgggcttttcaggcaggcccttatggtggccggccagtttgggaccctcccattttgatacattagttccccctcagctactggagatctcagccacaactgggctccagctgtgacccagactccgccaggatcccctagatcctcagctgtcagataatcccctgtccccctcctcctccccactcaacccccagtgcttgacatgaatgcatgtgtgcttcctaggactagaggccggtgctgtctctaccattgccctcactttaaggggcacacgagcagatggtagcaagccctggagagcagcactcgggcaagtgaggtggctctggcactgcccctggactttcatgtttgtagcttgagctggttttaattggaagctctgtgatttacataatcacttacaatctctgtaaataaggaactatttatgaggaattgtaaatttcctctctcccccttcttaccctgtctgtgatcttgtctgtgatgcagtaatgatattccactctaggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtgatgccattctcaattttaatgtcattgatctgataatgcaaattttaacagcacatctttaccacttcctgccttaaataatagttgttaatacatttccagtatttcattgaatctaagatccattgattgtaagacacacccttattttctacttcact

SEQ ID NO: 465656 - DNA, 1574 bp, Homo sapiens
  misc_feature (3)..(3): n is a, c, g, or t
  misc_feature (5)..(9): n is a, c, g, or t
  misc_feature (12)..(14): n is a, c, g, or t
tancnnnnnctnnnaaggaacacagttggattcaagatcttcactctctatcaacataccgggggagttgggggctgagagaatcattgatcatgaaggtgtcgcttgccaggaagacctgaagcagagatggcaatgcttgtgtcatccccagagccaactctaatgggcaagtagcaagttcctggagggctgcgttgagagggattccgggactgactgggctgcctaggaaagcgttgtctcctgacagcactgactaggcctggaggccttgttcctgctcaaagcagccaacacacgactaagcaaagaccgtatgtctcaaggacaccaggccaaggtagggagtggtgaggggagggctgtccattctaaaacacaaaatcgttggtttccgaatggaaacaagattctttgaggaccccacaaagcccccttcttccctgctaccttaagcccttctctctccaacatgcaaaaaaaattcccacctaaactttgtcagtgattttgatggctcagtctggtaccattttccctgggagggtacgggataagttggaggggaaggtaaggaagatggccttttctctccttctgtctgctcatgactcaacataatggtgaccctacaaattaactttgcctcgagggaggccgtgaaggggcctccatcccacaggacaaagttggcccaattcctttctctgggagcccgcaagccacatggacagcccctggatgtttgctctgccagtgggaatccaaacggaagaaatggaaaacaaacagcagaagataatttttataagcaagatgggctgtggctctggatacctggctcaaatttctcagtccccaagcaggccacggggactgcagcaaacagagcggcagaaacaacccacccaccaattaaagtcaaaccagccccaaacccctcccccaggagaaatggggacagccagaaaatttgtctgtccttgtctcctctttcttcctaacctttctatttctctgaggtgtttgaaatttttcttataacaaaaacatggaataaaataaagtcctgtaccgccaaagtaacaataacaataatcatcatccagtaaaaaataaaagcttcagcagaaccgtgataagtcttttttcttttttttttctgcttgtttgattttttctcttaactgtgcaaaaaaaaaaaaaaaaaatcaaaatgcactcactcatacacacgttcacacacgcagcttccatccagcaaatctgtgttaaatacgtttgtgtctctttcctccccaaccctttatatgtgcaaaaatattgtagtgaccgaggtacttcctcagaccgtctcccacatgtaccctttctggccttccaggtcctgtgactgacttcttgggagggaataaaatgatcaaggatagaaaagtcaagcttctccacctggtactgcacttgccaaaacctttggttatttattttttttcttcctcttccaatgcattgtttcccattttcctcttcccattaggttgctcatgtcttttccaccatctgtcctctgc

SEQ ID NO: 465657 - DNA, 738 bp, Homo sapiens
  misc_feature (3)..(3): n is a, c, g, or t
  misc_feature (5)..(9): n is a, c, g, or t
  misc_feature (12)..(14): n is a, c, g, or t
tancnnnnnctnnnaaggaacacagttggattcaagatcttcactctctatcaacataccgggggagttgggggctgagagaatcattgatcatgaaggtgtcgcttgccaggaagacctgaagcagagatggcaatgcttgtgtcatccccagagccaactctaatgggcaagtagcaagttcctggagggctgcgttgagagggattccgggactgactgggctgcctaggaaagcgttgtctcctgacagcactgactaggcctggaggccttgttcctgctcaaagcagccaacacacgactaagcaaagaccgtatgtctcaaggacaccaggccaaggtagggagtggtgaggggagggctgtccattctaaaacacaaaatcgttggtttccgaatggaaacaagattctttgaggaccccacaaagcccccttcttccctgctaccttaagcccttctctctccaacatgcaaaaaaaattcccacctaaactttgtcagtgattttgatggctcagtctggtaccattttccctgggagggtacgggataagttggaggggaaggtaaggaagatggccttttctctccttctgtctgctcatgactcaacataatggtgaccctacaaattaactttgcctcgagggaggccgtgaaggggcctccatcccacaggacaaagttggcccaattcctttctgtttcaaactaaagctcccacctaaact

SEQ ID NO: 465658 - DNA, 1168 bp, Homo sapiens
  misc_feature (3)..(3): n is a, c, g, or t
  misc_feature (5)..(9): n is a, c, g, or t
  misc_feature (12)..(14): n is a, c, g, or t
tancnnnnnctnnnaaggaacacagttggattcaagatcttcactctctatcaacataccgggggagttgggggctgagagaatcattgatcatgaaggtgtcgcttgccaggaagacctgaagcagagatggcaatgcttgtgtcatccccagagccaactctaatgggcaagtagcaagttcctggagggctgcgttgagagggattccgggactgactgggctgcctaggaaagcgttgtctcctgacagcactgactaggcctggaggccttgttcctgctcaaagcagccaacacacgactaagcaaagaccgtatgtctcaaggacaccaggccaaggtagggagtggtgaggggagggctgtccattctaaaacacaaaatcgttggtttccgaatggaaacaagattctttgaggaccccacaaagcccccttcttccctgctaccttaagcccttctctctccaacatgcaaaaaaaattcccacctaaactttgtcagtgattttgatggctcagtctggtaccattttccctgggagggtacgggataagttggaggggaaggtaaggaagatggccttttctctccttctgtctgctcatgactcaacataatggtgaccctacaaattaactttgcctcgagggaggccgtgaaggggcctccatcccacaggacaaagttggcccaattcctttctctgggagcccgcaagccacatggacagcccctggatgtttgctctgccagtgggaatccaaacggaagaaatggaaaacaaacagcagaagataatttttataagcaagatgggctgtggctctggatacctggctcaaatttctcagtccccaagcaggccacggggactgcagcaaacagagcggcagaaacaacccacccaccaattaaagtcaaaccagccccaaacccctcccccaggagaaatggggacagccagaaaatttgtctgtccttgtctcctctttcttcctaacctttctatttctctgaggtgtttgaaatttttcttataacaaaaacatggaataaaataaagtcctgtaccgccaaagtaacaataacaataatcatcatccagtaaaaaataaaagcttggcgtcgttggcctcagcggtggagctctgtggccggaac

SEQ ID NO: 465659 - DNA, 1254 bp, Homo sapiens
tgcctctctctcgcacgcactctctctctctttctgatctttgtctcattctgtttctcctcccagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacgacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcacaccctgatccggcagcatattgattatggacattggtatgatagacagaaggtgatgcttaaagaaatccataactgccagtatgtcgcctgcatgaatccgatggtgggcagcttcaccatcaatcccaggctacagggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtagatcttgccaatttgtacatccgaactggagccaagaacatgcccactgtgttcctgctgacagatgcccaggttctagatgagagcttcctcgtgctgattaatgacttgctggcatcagaaggatttcgtaaagttttgtaacggtgtattatttgtatataggagagctgttgatttttaactttataaacagctaccttactgtctctcttatagtttataatagttggttgatatcatatagcctgcaggttcttatattaaatcaacttcggaggaattatctgcctttcaatctgcaggatgcttttctatttttcttggttttgtaaagtatttcttcctctggct

SEQ ID NO: 465660 - DNA, 2751 bp, Homo sapiens
cagcagcgtttgtatagggatgtgatgttagagaactacggaaacctgttctccttggctggctctttgcattttactgcagagatattgctggagcacgacataaacgattcatttcaaaaagtgatcctgagaaaatctggaagctgtgaccttaatactttacgtttaaagaaagactaccaacgtgtgggtaattgcaaggggcagaaaagcagttataatggcattcatcaatgtttgtcagctacccgtagcaaaacctgtcaatataataaatgtggcaaagcttttgggttgtgctcaatcttcactgaacataagaaaatttttagcagagagaaatgctacaaatgtgaagaatgtggcaaagactgtaggttgtcagattttaccatacagaagagaattcatactgcagatagaagttacaaatgtgaagaatgtggcaaagcctgtaaaaagttctcaaaccttactgaacataatagagttcatactggaaagaaaccctacaaatgtgaagaatgtggcaaaacatttacctgttcctcagcccttactaaacacaagagaaatcatactggagacagaccctacaaatgcgaagaatgtcacaaagcctttaggtgttgctcagaccttactaaacataagagaattcatactggagagaaaccctacaaatgtaaagaatgtcacaaagcctttaggtgttgctcagaccttactaaacataagagaattcatactggagagaaaccctacaaatgtaatgaatgtggaaaagcttttatgtggatctcggcccttagtcaacataacagaattcatactggagagaaaccctacatttgtgaagaatgtggcaaagcctttacctactcctcaacccttattagccacaagagaattcatatggaattgagaccttacaaatgtgaagaatgtggcaaaacctttaagtggttctcagacctgactaatcataagagaattcacactggagagaaaccctacaaatgtgaagaatgtggcaaaagctttacctgctcctcaaaccttattaaacacaagagaattcatatggaagtgagaccttacaaatgtgaagaatgtggcaaaacctttaagtggttcccagacctgactaatcataagagaattcacactggagagaagccctacaaatgtgaagaatgtggcaaaacctttacctgctcctcaagccttattaaacacaagagaagtcatactggagacagacctacaagtgcaaagaatgtggcaaagcctttaggtggttctcagaccttactaaacataagtaaacacaagagaattcatactggagagaaaccctacatttgtgaagaatgtggcaaagcctttatccgctcctcaacccttacaagccacaagagaattcatatggaagagagaccttacaaatgtgaagaatgcggcaaaacctaccttgctaaacataagataattcatattggagagaaaccctacaaatgtaatgaatgtggaaaaggttttatgtggatctcggcccttagaaaacataagagaattcatactggagagacaccctacatccatgaagaatgtggcaaggcctttacctactcctcaatccttattaaccacaagagaattcatatggaagagggaccttacaaatgcgaagaatgtggcaaaacctttatgtggctctcagactttactaatcataagagaattcaccctggtgagaaaccctacaaatgtgaagaatgtggcaaagtattgagctcgttctcacacgtcattagacataagacaattcatagtagagagaagctccacaagtgttaaaaatgtggaaaagcctttaacaattcgtcatattgtgttcaacatcagagacttactactgaacaaatgtagtataaaggttattatgatgtttgtaatgaagatgagtataatggagctatatgtttctgaattctgaacaactatttacaaaattttatcctacttttttctgttgaaaatatgacttctctcgtctgctaaacacgtacagacctttagttttgatttacatcaatttaaatatacaaatgtatcactgtaaaataaactttaagtgtaacagatttatagagaaaatattcgtatttgtttatggttgtatacctattttgagaagaaaagaaaaatattagagtgaaacagataattttacatgtgttgatatcttgccagcaaaccagtaatttcaaagattttgaaagaaaatctgttttctctgctttgtattaaattcatttatctgaaatgttattgctcctgacttagaatcatcttttgcaaattctttttttgtttgtttgtctgttttcttgttgttcaccataggcataatatatcattttcttgtcatctaatttcagaaaacattatttgtactatcccctcagagattatgaaagtgactgataaaatttaatggtgttcataaaataattttcacatgtaatttcacactgagtgtattattgtatgttatttagtatattttacattttgtttcaattagagaatgctatttaatccaattttcatttagttattgatcattttactttgtaaaattgatataattgattttattaaatttattgggtcaatttattcaagtagagttgaacattttattttggcatatacatgaaataaaccaacaaaagtaatact

SEQ ID NO: 465661 - DNA, 1418 bp, Homo sapiens
gctatgtcttcattctagaatttatgtgaaagaacatggtcaatggttgctgcaccagagttaggagaagttcttccgtatcagatgaaaagatttatatactttcctatggaagattaagagaaatgaaatctaagatacatgaagaaattctaagtggaaaggccacttagtggttgatttacaacagcattataagtgacagggtgatagaagtgtggtaagtgattaggataatattctgcatagtaagagaaacaatttgaattttagaaggaaattgctttaccatttgcaaactaaggtaattaaaatacagtgagtttcaaaatgcctttttaatgacaatgtatgaacttaatttattttaataaaccaaaattattgttattgagttaaggctattttacactgaatgtgtatcttgccactgatgttaacttatcccatcttacccaaggttgtaggtcaacagatggtaacaatatactattgtgtgactgtggaataacatctctagtgatttctttgtcagtggtctttaacttaccataatttggagaatatgattcctacaaattaacatttttgtttttcttgtaactacaggttattatgatgtttgtaatgaagatgagtataatggagctatatgtttctgaattctgaacaactatttacaaaattttatcctacttttttctgttgaaaatatgacttctctcgtctgctaaacacgtacagacctttagttttgatttacatcaatttaaatatacaaatgtatcactgtaaaataaactttaagtgtaacagatttatagagaaaatattcgtatttgtttatggttgtatacctattttgagaagaaaagaaaaatattagagtgaaacagataattttacatgtgttgatatcttgccagcaaaccagtaatttcaaagattttgaaagaaaatctgttttctctgctttgtattaaattcatttatctgaaatgttattgctcctgacttagaatcatcttttgcaaattctttttttgtttgtttgtctgttttcttgttgttcaccataggcataatatatcattttcttgtcatctaatttcagaaaacattatttgtactatcccctcagagattatgaaagtgactgataaaatttaatggtgttcataaaataattttcacatgtaatttcacactgagtgtattattgtatgttatttagtatattttacattttgtttcaattagagaatgctatttaatccaattttcatttagttattgatcattttactttgtaaaattgatataattgattttattaaatttattgggtcaatttattcaagtagagttgaacattttattttggcatatacatgaaataaaccaacaaaagtaatact

SEQ ID NO: 465662 - DNA, 2262 bp, Homo sapiens
tcggtaccctcataggttcgcaggtacaaatgtgaagaatgtggcaaaacatttacctgttcctcagcccttactaaacacaagagaaatcatactggagacagaccctacaaatgcgaagaatgtcacaaagcctttaggtgttgctcagaccttactaaacataagagaattcatactggagagaaaccctacaaatgtaaagaatgtcacaaagcctttaggtgttgctcagaccttactaaacataagagaattcatactggagagaaaccctacaaatgtaatgaatgtggaaaagcttttatgtggatctcggcccttagtcaacataacagaattcatactggagagaaaccctacatttgtgaagaatgtggcaaagcctttacctactcctcaacccttattagccacaagagaattcatatggaattgagaccttacaaatgtgaagaatgtggcaaaacctttaagtggttctcagacctgactaatcataagagaattcacactggagagaaaccctacaaatgtgaagaatgtggcaaaagctttacctgctcctcaaaccttattaaacacaagagaattcatatggaagtgagaccttacaaatgtgaagaatgtggcaaaacctttaagtggttcccagacctgactaatcataagagaattcacactggagagaagccctacaaatgtgaagaatgtggcaaaacctttacctgctcctcaagccttattaaacacaagagaagtcatactggagacagacctacaagtgcaaagaatgtggcaaagcctttaggtggttctcagaccttactaaacataagtaaacacaagagaattcatactggagagaaaccctacatttgtgaagaatgtggcaaagcctttatccgctcctcaacccttacaagccacaagagaattcatatggaagagagaccttacaaatgtgaagaatgcggcaaaacctaccttgctaaacataagataattcatattggagagaaaccctacaaatgtaatgaatgtggaaaaggttttatgtggatctcggcccttagaaaacataagagaattcatactggagagacaccctacatccatgaagaatgtggcaaggcctttacctactcctcaatccttattaaccacaagagaattcatatggaagagggaccttacaaatgcgaagaatgtggcaaaacctttatgtggctctcagactttactaatcataagagaattcaccctggtgagaaaccctacaaatgtgaagaatgtggcaaagtattgagctcgttctcacacgtcattagacataagacaattcatagtagagagaagctccacaagtgttaaaaatgtggaaaagcctttaacaattcgtcatattgtgttcaacatcagagacttactactgaacaaatgtagtataaaggttattatgatgtttgtaatgaagatgagtataatggagctatatgtttctgaattctgaacaactatttacaaaattttatcctacttttttctgttgaaaatatgacttctctcgtctgctaaacacgtacagacctttagttttgatttacatcaatttaaatatacaaatgtatcactgtaaaataaactttaagtgtaacagatttatagagaaaatattcgtatttgtttatggttgtatacctattttgagaagaaaagaaaaatattagagtgaaacagataattttacatgtgttgatatcttgccagcaaaccagtaatttcaaagattttgaaagaaaatctgttttctctgctttgtattaaattcatttatctgaaatgttattgctcctgacttagaatcatcttttgcaaattctttttttgtttgtttgtctgttttcttgttgttcaccataggcataatatatcattttcttgtcatctaatttcagaaaacattatttgtactatcccctcagagattatgaaagtgactgataaaatttaatggtgttcataaaataattttcacatgtaatttcacactgagtgtattattgtatgttatttagtatattttacattttgtttcaattagagaatgctatttaatccaattttcatttagttattgatcattttactttgtaaaattgatataattgattttattaaatttattgggtcaatttattcaagtagagttgaacattttattttggcatatacatgaaataaaccaacaaaagtaatact

SEQ ID NO: 465663 - DNA, 358 bp, Homo sapiens
atgtggcaaaagctttacctgctcctcaaaccttattaaacacaagagaattcatatggaagtgagaccttacaaatgtgaagaatgtggcaaaacctttaagtggttcccagacctgactaatcataagagaattcacactggagagaagccctacaaatgtgaagaatgtggcaaaacctttacctgctcctcaagccttattaaacacaagagaagtcatactggagacagacctacaagtgcaaagaatgtggcaaagcctttaggtggttctcagaccttactaaacataaggtaattcatactggagataaaccttacaaatgtaatgaatgtggaaaagcttttacgtggt

SEQ ID NO: 465664 - DNA, 1725 bp, Homo sapiens
aagtaaacaggatttggcgctctacataatggctataaagaaacataaaggtgatttctccaagtgttatgctagaagcaacaatgccctcaggcttagtgaaattgaccaaagtttgaaggcagcattgcatcaaatggaaggaacaagtgatgagacatcaggaaaatatcagaatgaaagagaaatgcaaggctctaaaggaagttccaactcacttcgacaccctccagttagcaaagaggtgacagaatcccaaaagggcaggggagagattatggatagcaggctcctggaggaaaaactagatgcaaacgtcctggcattcatcctgcctgcttgctgtttgtaccatctccgtggtagcaaccatccaagctgctggaagcacagactgagctctatgagtcaattattttatatacctgggaacgtgctagccttcctgtcactctttgatgtcactatgtagacagtttgcagcctaggcaacatgggaaaaagtgaaacacttcactcagggcgcagaacaatggaagtccctggaaggaaaggcttgcaagagaaaaccaagtggcttctgagatattcgaaagtccagttgttttccctttttaaaaattttcagatgctctttgatgccatttcataaagcctgtgattgggccaaaagtcttagttcaccatgtaccacaaatagtgtactctatatagcatatgcttaactaagaaaaaataaagatttagaaatagatgtattgaggacatgccattaaaagcagcttccattgaatcaactgtttttcagagtactgtcaagattaccttaaactagtctaatcaaggtaggtggtggattccaaacttgggaaaaagtgagtctttgtattctgtgaagtttaataactacccaaggaagaagtgttggatacaacaactatgagtatcttagaaagtatgtcttttttttttttctgagtcagggtcttgctctatcacccaggctggagtgcagtgatgtgattataactcattgcattgcaatcttgaccccctgggctcaagccatccttccatcttagcctcccaagtagctaggactacaagtggatgccaccatgcccagctaatttttttcttaatttcatttttgtagagataggatttcccaggctggtatcaaactctcaaacttcctggtctcaagcagttctcccaccttggcttcccaaagtgctggcattataggcatgagccaccacacccagcctgggtgtctgtctttatgctaaatgtccgagcctttccatttgtcttttgcctcttcataaacctctgctgagctttatcaggtcattcacatctttcattacaggcaagtggtaaacttagtaatatgcttcctctggtgacaatgggcaaaggactagaagcataagtaaagaaatagtagactgaaataagcggattttgacatgcaaaaagatgcagcaaggtgaacctggttaagaaatagactcagagagcttgaacatggaaggatgctaggacaagtggcagctaaggcagaaagacagccatggttccagatgtctggggaaacaatggaaggcagatattacaaagttttccattttgtaccagaagtgtccgtatgaacacaaactcctaaacccatggatatggagagctgactgtaatagtcaaagacaagagtggctggtg

SEQ ID NO: 465665 - DNA, 2195 bp, Homo sapiens
  misc_feature (2)..(2): n is a, c, g, or t
  misc_feature (6)..(6): n is a, c, g, or t
  misc_feature (10)..(11): n is a, c, g, or t
  misc_feature (13)..(13): n is a, c, g, or t
  misc_feature (16)..(16): n is a, c, g, or t
anaacngggnncngtngaaaggacaccagcttggaatcagttcggacctgtgtctgctgcacagctgaatccctgggaaactcttttagtgtagcatggcagaaagaacaatggctatgcccacacaaatacctgctgatggagatacatagagaccgggtttcaccacgctggccagactggtcttgaactcctgacctctggtgatctgcccacctcaacctcccaaagtgctgcgattacaggcgtgagccactgtacctggccatcaaaaagaaaataatattcgttgtttaactacgattggacattttggttttgaatgtttgcccaatcagttgcccctttatgtccctatgacaatgactctatgtctattacaggggagactggaattggaaaatcgacactgatagacacattgtttaatactaacttgaaagataacaaatcctcacatttttactcaaatgttggacttcaaattcagacatatgaacttcaggaaagcaatgttcagttgaaattgactgttgtggagacagtagggtatggtgatcaaatagacaaagaagccagctaccaaccaatagttgactacatagatgcccaatttgaggcctatcttcaagaagaactgaagattaaacgttccttgtttgagtaccatgattctcgcgtccacgtgtgtctttacttcatttcacctacaggacattccctgaagtctcttgatctattaacaatgaagaaccttgacagtaaggtgaatattataccactgattgccaaagcagacactatttctaaaaatgatttacagacgtttaagaataagataatgagtgaattgattagcaatggcatccagatatatcagctcccaacagatgaagaaactgctgctcaagcgaactcctcagttagtgggctgttaccctttgctgtggtagggagtacagatgaagtgaaagttggaaaaaggatggtcagaggccgtcactacccttggggagttttgcaagtggaaaatgaaaatcactgtgacttcgttaagctccgagatatgcttctttgtaccaatatggaaaatctaaaagaaaaaacccacactcagcactatgaatgttataggtaccaaaaactgcagaaaatgggctttacagatgtgggtccaaacaaccagccagttagttttcaagaaatctttgaagccaaaagacaagagttctatgatcaatgtcagagggaagaagaagagttgaaacagagatttatgcagcgagtcaaggagaaagaagcaacatttaaagaagctgaaaaagagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaataatagtttctcttactattctgagagccctatcattctacatcgcaacttcctgtgagattgtctttgtagcatttaactctgaagttctcattttaaaaattggcttgcttattgtatattttccccaactaaagtgtgaactcctagcggggtgtggtggctcatgcctgtaatcccagcactttgggaggctgaggcgggtggaccacctgaggtcaggagttcaaaaccagcctgaccaaaatgatgaaaccctgcctctactaaaaatacaaaaattagctgggtttggtggccggtacctgtaatcccagccacttgggaggctgaggcaggagaatcacttgaaccccggaggtggaggttgcagtgagccaagatctcaccattaacagctagaaagagccttgttcttaacccaacaggcctcttctaaaaatgttttctatatcagcaagactaattaaattggaaaagatcaccaactaaatgataaaacaagaataaacagaagtataaacattcacaggagttagatttgaagacaattgcttttaacacagagactcaccaggaggtgagcatcatggagggggttatttattatgtgttttactttgaactgagaacatgtgcattgattaggtcaaaagtgttcttgtcctagcatagtgaaggaaatgtatgc

SEQ ID NO: 465666 - DNA, 1533 bp, Homo sapiens
tctaaaacctgtcaaacttgaggttatcaccttccactttgctctctctcccctgcttcatcatgtaaagatgtgcctgcttccccttcgccttccgccatgattcaagctaaggtgagtggagaaaaagagaggcaagcttatgccaagggaaatatctatagcgaggacacgctgtctttgactcgcaaagggacttcggtgaagcagctaggaggaaacgtaccattaaatgatatggttacaatagaatacagtgttcttccttttgctatcacatttctggaaataatttacctagaaattttccctgaagtatggttctcttactgtgacaaaggaaaatgtaggaccacagcaacatttgctgaaagaacaataattcataatttcactgaaagaaggaaagtgtctttcctggagctgcaagctgcattgcctatggttgagggagaagtgatgcaagcacttccttggcttctccagcagaatctctctcagtgccatgtggtcactgctggggatgaaagagggttgctgtcagcaattcagtactctctttcttattctcttcaatgcctctttccttgctatgatgttaaaaccagttttccttctaacagtcgggaccctcagctgcaggtctgttggaatttgctggaggtccactccagatcctgtttgcctgggtatcaccagcgaaggctgcagaacagcaaatattgctacctgatccttcctctggaagcttcatctcagagggacacccagctgtatgaggtgtcagccggcccctactggcagttgtaccgtctgttacagcttcccttggctgggaaagggaaatcccccaaccccttgcacttcccaggcaacaaccatgatagcatccgggaacctggtagtagcaatgccatcaagagtggctggacacatccagggattcctgtagaagcaccagaggccacagggtttgagaaaacttgtccatgggacacaggaaacatctacaaagtaagtgaaaataattttgaagagagttttaagtcttacactgaaaggcataggctagagccagctgactcaggcctaaagcaaacaccatttgtgggtaataaacttctagggacccctgacccctccccgcagtaggaggcagtaaagtacctgcggtaggacaaaggttagtcttaagcccatataagtaaacaggttagtaagataaacttccctttgtttactactctaatctatttagctaaaggtgtttttatactggtgcatattcacctttggttttaatatttagaactccatttaacatttcttgtaaggttggactggtggtgacaaatactaccagcatttgcttgtccaagaaggctttatgtctccttcaattatgaaatgtagttttgctggatataaaattattgactgatagttactctgcttgaggagactaaagataggtccccaaacctgtctagcttgtaaagtttctgcaaagaaatctgctgttattctgataga

SEQ ID NO: 465667 - DNA, 2937 bp, Homo sapiens
tgacctcagaatgtcacactcagttttggagcctcatggcctccctgtgattcttggggatctactcttttggttcacctcatggccattttctaaggtgcaggccagccccaggagccctgggttagaaccattttcaacaaccttcaccccaaagatccacctcttgcccctttctagccaggtacctgcaggtgacatctctctgttaattccagatgaaaaattggaatcacggaccagaagggttttgagcaacacttatcagaaacttattcagtctgtcttcctggatgacagcatccctaatggagtcaagtatctcatgcttcttgccttgattgaaaagccgacagtggacccaatctacattgcattatttggaagcactggggctgggaagagctccctgatcaatgccatcatccagcaagcaatgtttctaccagtgtctggagaaagcatatgtacttcctgcattgtacaagtgagctctggctgctgtgtgcagtatgaggccaaaatccaccttctgtctgaccagctcatgcctttgttgaatgaaaagagcccatcccaggagaaagttcatcaagtgagctggggagggggtctagcctggtccttgcatttttatgagactttgggcaagccattcccctcttcgagaccccagatagatgacctagattttctgaatatgcagccccctggccctccacagggggcaatgggcccctctgtttgtcggtgttctctgtgtctgtgtcaagaggggcttggccctactctgccttggcaggagtggagggaggagctgaagaacctgaccaaactcctgcataggacggaggagctgggcagagaagaggcagatgcgtggaacagggatgaggcagtggaggaagccacctggaagctacaaatgatttatggaaatggggcagagagtaagaactatgaggagttactgagggcgaagcccaaaaggaagatccccacctccagagtcatcaccctcaaggcggaagaggcagaagagctgtccatcaagctggacccctacatccgcacacagaggagagattgggatggagaggccgctgagatgcgcatctggcccttgatcaaacatgtggaagtgacacttcccaaatccgacctgatcccagaaggggtcgtgctggtggacatcccaggcacaggcgacttcaacagcaagagggacgagatgtggaaaaagaccattgacaagtgctcagtgatctgggtgatcagcgacatagagcgagtttctggggggcgagcccacgaagaccttctgaatgagagcatcaaagcctgccagcggggcttctgtagggacgtggccctggtggtcaccaagatggacaaactccacttgccagaatacctaagggaaagaaaggcaggaaatcaagctattcagagtcagcgagaggctgttttagaaagaaatgaaatgataaaactacaaaggactagaattctcaaggaaaaactgaagagaaaactgccagctgacttcaaggttctggaagcctcagatctggtgtatacagtcagcgcccaggagtactggcagcaggctctcctcaccgaggaggaaacggaaatccctaagttaagagaatacatcaggaagagcctcttggacaagaagaagaggacagtgaccaagtatgtgactgaagcctttggcctgttgctcctcacagatagtttcaactccacgcaaaacctgccgaatgaacacttgcacatgagtgtcctgcggagatttgcggaagagaaggttgagctgctggagaaggccatcgcacagtgcttcgcctgcatggagcagcctctgcaagaaggggtcaggaccgccaggacttcttaccgctgcatcctcagagcatgcttggtgaggagtaaaggaaaccaaggttttcatcagaccctgaaagctgtttgcctgaaaaatggcatctatgcctccaggactctggcgagaattgatctaaatgaagccctcactcagcccgtctatgaccagatcgaccctgtttttggaagcatttttaggacggggaagcccactggttcagctctgatgcctcacatagatgcttttaagcagtccctgcaggagaaaatgacagaaattgggataagaagtggctggaaatatgatagctgcaaaaaaaatttcctgatccaggagataagtgccatcctcgggggcctggaggaccacatcctcagaaggaagaggaggatctacgagtccctcactgcctctgtccagagtgacctgaagctctgttacgaagaggcagctcagatcacgggcaaaaaagcgtgtgagcggatgaaagatgccatcagaagaggagtggaccggcaggtggctgagggcatgtttgaaagggcccaggaaaggatgcagcaccagtttcagcagctgaagactggaatcgtggagaaggtgaagggcagcatcaccactatgctggcccttgcttcgtcccagggggatggcctctacaaggagcttgcagctgtggaccttggtgtaggcaaccatgtccctttcaggccatgggctccatcaggcccccggtataaactggagagggtaacctggtacaaacagcaattaagtaatttctagccaaatttaaaatgcacatatcatttggcgcagcaaccctacagatatccttatatggggggagggtggcatatagacaaggttattcagggtaacattctaaagtcagaaatggggacaactcaaatatctgtaatttatctgtaaaatggtgacaatggtagtacctaccctgatactgctagggttgtcaggaagtttaggataatgcttacaaaatatggacacattgtacttaatagtacttgataaatggt

SEQ ID NO: 465668 - DNA, 805 bp, Homo sapiens
cgctatatctattggtcaccagcagtcccccacgttagactatctaccggtaactaaaatcaaagtggggtcgctatgctcgagatctcttcagtactctgggctacgttccattgcttgactatgttagctaaagttcatctctgcggcctggagtgatgtgagtcagggcagccatatatacagctggtagctagatctctgatgagctcccatgcctgacagtgtgttgcgagctcgttggtggatcatgaaaattgtgaaatgagtgatgcatgatagatttggaacgtcctctgccactcatgtgtagaccgatccgcaaagtttgcgtctagtgagattcaaacaggaagaatataggtgacaacatggagttagatgaaacaggaacaaaacatgttaaaattgttgcagaagatgatgaggacttcacaagtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacattttggatggaaagatgagacactgaaacaatttgaagattggaaggtgagagtctgaggtccaaagctttacaccagttgttgaagaaccttgatcacaggccagccaggacctcaaaggctcaagagaattgcatagctttcttatttaataaattctgtagttcac

SEQ ID NO: 465669 - DNA, 803 bp, Homo sapiens
cagggtatgtaaatgtgggagctcaaaggagggacatctaactccaacagtttgccagttgtggggaagaaaggttttcaaagggaatgcttccagtttttgcccattcagtatgatattggccgtggatttgtcatagacagcgcttattattttgaggtgtggcagtgcacagaggactgccacatgcctctggctcaagaccaagccttgaggaccacggagataaagaagttccaatgccacctgtcccagtgcaccatgcattgcaacgacaaagccagagattcactagatgcagggacctttcaccagtgtaaccatcccaaatttgcatcttgtctgatgctaactgaggaagaagggcacctggagtttgaccagcaggaacaaaacatgttaaaattgttgcagaagatgatgaggacttcacaagtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacattttggatggaaagatgagacactgaaacaatttgaagattggaaggtgagagtctgaggtccaaagctttacaccagttgttgaagaaccttgatcacaggccagccaggacctcaaaggctcaagagaaatgatgacaaggtttgcttggcttatttagagctgggct

SEQ ID NO: 465670 - DNA, 957 bp, Homo sapiens
taaagagggaattatgacacactgctggccccagcaccctgatgatgtgactctcctgcatgtgctggagccacagaaggaattaaaattgacctgcaagacgtctttacttcatggagatctgtagaagctgaagtccaaaatgtgacgatgaagctcggcaattacaaaatctatagataaagaaagactgccaaggaagagtaagatattcattgacacaaatgctgttgtatgaaccatgtcccaatgaaagtagacaactgtaatgtccttgagaatattttctgcaatatttgtggcaaattcatttatagaactggatattaatatattactacaggggctcaataggctcagtaatgtcacttctaagattctacagaaaggctgtttggaacctgatttgtcaaaacacaagttagatgctggctcaataggctcagaaatgccatttttaatttctaccaaaagagtgtttggaacctgtttcatcaaaatgcagatgcttcctgccctcaaacatcggattccaagttcttcagttttgggactcggactggctctccttgctcctcagcttgctgacagcctgttgttggaccttgtgatcattatcaagaaattaaaaagaaagaagaaaaaggagaagtgggcagacacgtgtttgttatgtgatagggaacatgtatctcactgagctggtacaggtggtgcacccattcctaacttgttacaaccatccaacaagtgaccttttgatgaagggatcttttattttaagtttcttcaggcagattcctgaggtcttatttgcatctgacacaggtacagcatgttacctttacctaaagcatttttttctcctttaagagaaaaaataaaccttaccttataagtcctgcatttaatcaatagctttttattggctacctggtttatgccaggcactataca

SEQ ID NO: 465671 - DNA, 5804 bp, Homo sapiens
cctccaggccacaggtccctcggggctcccagacagagaggcttagggcagccccaacggaggggctgtccttccactgctaagcggctgctgcagtcaagctctcctgtccctcctgtgccgccttcctccccggatgggccccgtgatgaggtctctgtgcgatggggaaaccgaggccccagcagacacctgggatgcagagacgccggcaccgctatgtgtcctcgggcaattcgctgaacctttctgggcctcggtttctcaccaattccaaaagctgattctgctaccgactgctgtgagggtcccaggggacgggaaagcccgggcagcgcccaccggggctcaggagcttgctgactccgagggggtggggccgggcctgggcaaggggtggggccgggcctgggcaaggggcggggacggggcctgctcgacgtgctcggcgctcccggggtgcctgctcggcgctccgccggccgccctgcgtacgctcgcaaggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtctctcaggacggagggcatcatcctgcctcttaggttggctgaggcctgcgtgtggtgtccttagaaatgggcttcgaatagaagctccagccctgtgggggcgtctcctgggtagggagtggcgtcccgttttcccttaggagggtgtttctgcattgaacccctgagtgggacggcgttcccggcaaagctgggagggaggcgagcgtggggcaagacccttgtcttcgaggccggggccctcttgtatggggcggttttatgttgcagtcctctgatactttctgagttcaaagaggtaaatgtataaatttcagtcccttctgaacacagatatcatcagaaaattaccattccctagcaggatgttttcgtgtttgtattcgtatatgccagttcatttcctttgaaaaaaaaaaaaagtggaacacaaagtaggaagtgagaaccttctggctttggatggattgacttcttgattctttctggttttgcctgaacaccaagtagcttcataatcaaagggtcattttctggtttgtatcagaccgtatttataaagttgggtatttaatttcagtaactcctgtattttaacagaaaaagaacctgagtccatttgcagttaggctcgcaccagctgtcttctgtgccagccagctccgcccgagaccccggcacgtgttcgcagcacagcctggcaggggccctgagcggagttctcagcccgtctgtgccaaagttgcctgtgggtcacggaaacccggcccatgtccacccagtgcgtcaggccagccggggcccaaacctgtggatggaacgcaggtgcctgcacatctggggcctcagccagacctgtctccttcccaggcactgtcggaaaggggctggctcctgtctggtcagtggaggatggtggcaggagacggggtggggaggtccaggtcacgtcctctctggcgaccctggcagtggctgtctccaagccctggcaggtggggccaccaatctggccgacctcaggctctgggaaacaggctgccctcgtccctctgcctgtgggtggctgaggcttctcagcccatctccagttctctgcagcaaaggccctctgtttctgtcctgcagtggtggccctttcgtggttaaacatgtccctcccctcctcacagaactgagtacctattgcggctgggcccgcccaaccctgtgtccctgcacccatgggttctaccacctgattcggctgcagctgtcactgtcccgtgtctgctctctgtcaggcctctgagtgctgcagacgtattaacatatcaccgctagttgatggaaagtcttgtttcttattagaatattttgtgtaggcacagggttgccccagcactgtctatagcaaccccagtgtcctcacagtgcacgtgagccgtgacgcagccaccgtggagtcggcgctgacgcggtgtggccacgtgccatgagctcgccaacgcagtgcggctatatggcgtgagcttactgtgaagtggagacaggcagggacacaggaaactacaaacgagaaatccagaaggaggagctggaactgatgggcatagccggccgcgagcccctccgagcacccctgggggtggagttctggctgtcatggcagagggtttcacatgctcaaaaagtaaatgaaccaggatgtgaggggaacacaacagaccatgccgacggagctcccgggcccaggccggggcctcttcccatcgcactctgacccgccgtcgggagtgcccaggcccgggtcgggcctgcctctccgctcgcaccgcactctgacccatcaggagtgtggggaagaccgtcgaccaaaggtgggaaagacaggaaagatactgtactctaagtagtaaatttgttttttgcgtggacgattctgaagctgtattctgagatggaaaaaactagaaatacatcgtggatgatgagagccaggtgtattgagctcctgcttttctaacgtacaaaggtaactggatagagaaacggagtgatcgccctcacctggccagggtgtgctccgagaccccagcaggtgccgaagccgcggatagtcccgaatcctgtccaggcgctgttttttcctgtacgtacctgtgatcaagtctgagatgtgacagcaaaactgacagaacttcgtgcttccctcttcaaaatgtcacagatgggcactgtgttcttaccggagatcttagcaacctcggcatctggctgtttttcttataggtcaggagtttccaccttttcccttaaaggaagcgcttggcagcttctctggtgtgtctgagtcgccagcatcaccactgtcctgttctggggccattcttaagtaaaataaaagcttcttggacccaagcaccacatcaccgcgatggctggtctgatcaccgagatggctgctgagtgcctggcaggcagggtggcgtggatggcccgaaacgctggacggagggagggttgatgtcccagcaggacggctgctcagaacagcacagaatcaaaaactcatgaatggtttatttctggaattttccacttagtatttttggactgtggctgaccatgggtaactgaaaccgtgtgtaagggggactgttgtgaggggctgtgcacaaatgcttcccagctcttgagggcctggacgcagtgacccgtgcactcagggtcttggccctgataccattctgtaaccaaaaggaaccagggccaggccagagaaggtatcagatgagctagagagtgaagaattgctgggatgaggagacttgttgaaataacacggggggatgggaaggagcatacggtggccagcctggggcagtgtgagcgtgaaaataaacaggctgggcgcagcggctcacgcctgcaatcccagcactttaggaggccaaggtgggaggatcacttgaggctaggagttcaagaccagcctgggcaacatgggtgaaaccctgtctctacaaaacaagaaaagtcagccgtgcgtggtgtcacccgcctgtagtcccagatactcaggaagctgaggcaggaggatcacttgagccagaggttaagtctgcagtgagctgtgattgtaccactgctctccagcctgagcaacagagccggaccctgtctcaccaaaggaaaaaaaaaaaaaaaaaagaaagaaaattaattattgtaatgggctgtagccctcagaataaattgatatccagtagtctatacaacataagtaattgcgtaaacatgtcagtggggggagggccaggtctgtcttattaattctaatatagaagaaattttgggaacaggaaactgctgttgcagaaaccacactggtgacaggtgcagattacaaccctcagcgggccgggcgccagtggctcacgcctataatcccaacactttgggaggccgaggcaggcagatcacttgaggccaggagttcaaggccagcctggccaacatggagaaaccctgtctctactaaaaatacaaaaattagctggggctggtggcgtgtgtctgtaatccagctattcgggaggccgaggtgggagaattgcctaaaccaggaggcagaggttgcagtgagcagggattgtgccaccacactccagcctgggcgacagaaccgtctcaaaaaaaaaccctcagttgccatgaagtgagtggtgacgtgtggtgtgaagcaggtgtctgctgtcttgagaaacctccccttgagatgcatagtgacctccgaggagacagtcatgtcacagcagaacggcagaggcccccttaacccagcagccaccgccgggagcgagccgcacaggccgcaccgacctgggggcgtccctgagggcacggtatcacctctggttctcttgcccaactgcatggcctgaatgtaatcccaaggagacaacagacacagacccaaaccgaggagccttctgcgaagtgactggcagcgctggcccagtgttatgtaagatgttatttggggaactgggtatacacactgtcctatttttggaactttttggaagtctgaaattattttgaaatgaggaaaaaaaaatatgctttgtatgaaactatagtggaatagattgagtcgattctcgtttcaaaataacttcaaagagtttccaataggcatgatgccggcatgaatggtttcagcaggtcacaggcagagaagccggaatcccaaaatagcgccattgtgtggacaacctgactccttacaaacgtgcagtggcttcccaacgctgcctttgagtttctgggtctggctgctgaatgtgttgtgcttaagaatccagacaccctgctgttcctgccagagcttctcacgagatatttcgggtagttcatcatctgtcatgtgcagaatgcattttatttctcatagacgcttgtcatgataagctggccacattattaaaaggctcccaaagacaatttccagagcgttttccaagcgttccccttgggcatgaggtaaaccggaggtagcgtggtcgcaggcctggcccggtgtggcttcccaggaggggaggtctgacctggaggcccagagccccccagggtcgggtctgcagccccagggctgatgcgtggggcctcgtttgcacaggccgtgtagccggagctcagcactggacctgttccacccaggcctcaggagcaaggcaaactgacttcctgaagcttcctgtatcggttcctctggccacagtaacagattactgcaagcccagcggcttagagcaccgcaagcattactattccagagcagagtccaaaaggggcccaggccagacacgatggcccacacctgtcatcccggcagtttgggaggccaaggtgggaggatcgcctgaggccaggagtttgagaccagccctggcaacgtagtgaaaccctgtctctaca

SEQ ID NO: 465672 - DNA, 1201 bp, Homo sapiens
cagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagt

SEQ ID NO: 465673 - DNA, 969 bp, Homo sapiens
atggaaaagagggctgggactagggtgatgtaggggatgcacctggcttaggtgcaaaatttgggggataccaaaagaactcagtaataaatcatattttaatgaaatatcttgaaaaggcaaaattaatgcaaagatacatgattaacaaaacatccaaagaggagtatttaacaaaaatggagaagcagagaagcagaagaattaggagaatatgctgtcacatgagccaaggaattaaagaattcaggaaggaggaagtactgctgtcagatgttcaacagaggtcattttagaaaatttaccttggtttttgaaatcctttcaaagagcagtatacacaatgtgagcaagtatccttcgttcattgccgtcattgatatggtttggatatttgtcccttccaattctcattccagggttaagcttcttctctgccctcagtaatgtggcccttccccttgtctgtatattttggagacatgaagcatgtgggatggcctcacagtcagctggggtttgagggtgaaattcaatgactttcgtgaactccttggctcctatgtgctcttcacctgggaggaccagggcatgtgcagggatgaccaccttctccctgggacctgaacagggcagagaaatggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagt

SEQ ID NO: 465674 - DNA, 565 bp, Homo sapiens
cccagggaccctgtgaaatactgtaaaaggtgacaaaatatctgaacagaagaggacttaggagagatctgaactccagctgccctacaaactccatctcagcttttcttctcacttcatgtgaaaactactccagtggctgactgaattgctgacccttcaagctcgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagt

SEQ ID NO: 465675 - DNA, 1061 bp, Homo sapiens
atggaaaagagggctgggactagggtgatgtaggggatgcacctggcttaggtgcaaaatttgggggataccaaaagaactcagtaataaatcatattttaatgaaatatcttgaaaaggcaaaattaatgcaaagatacatgattaacaaaacatccaaagaggagtatttaacaaaaatggagaagcagagaagcagaagaattaggagaatatgctgtcacatgagccaaggaattaaagaattcaggaaggaggaagtactgctgtcagatgttcaacagaggtcattttagaaaatttaccttggtttttgaaatcctttcaaagagcagtatacacaatgtgagcaagtatccttcgttcattgccgtcattgatatggtttggatatttgtcccttccaattctcattccagggttaagcttcttctctgccctcagtaatgtggcccttccccttgtctgtatattttggagacatgaagcatgtgggatggcctcacagtcagctggggtttgagggtgaaattcaatgactttcgtgaactccttggctcctatgtgctcttcacctgggaggaccagggcatgtgcagggatgaccaccttctccctgggacctgaacagggcagagaaatgggaagctcgggtgcaaagggagtggggaagatgggtccgggcttacagtactgaacccagggaatgacaattaactgtgtgtgttgctgcaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagt

SEQ ID NO: 465676 - DNA, 750 bp, Homo sapiens
gtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcagaagcaggaagcagaagcaggaaggcagaagcaggaagcagcgttttacactatatgaggtcctcctgagtgctgatcaaatgacatccgtgtgagtttccaacagccctatggcttgaaagagatcctggcagag

SEQ ID NO: 465677 - DNA, 1269 bp, Homo sapiens
gtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacaattacggggtgtggccataaatgtgtccctgcaggagggggatctacggtgggaggagcagcagcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacctggctgtgcccacccccatggtttcaaagggaggggtccctgctgggaggatttctgtgggatccccctggttggtactgggagggagttagactactgaagtagaccaccaagtggacactgggccccatttacaggagttaaggatgaggagcaataggttaaacccaagacaggcttctttggccagtaagcatcctttcttggccctaaggaagggtgcggttcccgtttctctgtaaatcgaagggcctagttcttgtttgcggcgcctttcgtgcatcattagggagagaatttctcagaaaaagggaaaaactaatatgttttcgcctctgaccatcgccccagttctgaggcctgtgggccgtggct

SEQ ID NO: 465678 - DNA, 770 bp, Homo sapiens
tgggctccatccccaagcagatagcatgatctgttccttttccacctggtgcttggcagtgtcatgcacaccttgggcacttactgaatactcattcatagtggtgaagccatccatggcttcccagcattcacacccttccctcccgacacgagtgtacacagtcctggaggaactgagtccaggaaccatcgtggccaatatcacagcggaggatcctgatgatgaaggttttcccagccacctcctctacagcattaccacttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcaggtatgcacactttgaaagttgggctggacattctatctctttggtggccctctgcccttctgcttctctggtatattctcaggagaattataagcatttggagaaacagctcagtagaataaatcgatgtgaactgttcactgttgtccacaggtttccttaattattttttattttgctcccttctatatctggctcatctctgttggtgaaaaggaccacagggacttgttaggccctccctggactgtgcctgttctttgtttattgccacgggtggcaagatggggctgttagttagcagttataatagac

SEQ ID NO: 465679 - DNA, 798 bp, Homo sapiens
tgggctccatccccaagcagatagcatgatctgttccttttccacctggtgcttggcagtgtcatgcacaccttgggcacttactgaatactcattcatagtggtgaagccatccatggcttcccagcattcacacccttccctcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcaggtatgcacactttgaaagttgggctggacattctatctctttggtggccctctgcccttctgcttctctggtatattctcaggagaattataagcatttggagaaacagctcagtagaataaatcgatgtgaactgttcactgttgtccacaggtttccttaattattttttattttgctcccttctatatctggctcatctctgttggtgaaaaggaccacagggacttgttaggccctccctggactgtgcctgttctttgtttattgccacgggtggcaagatggggctgttagttagcagttataatagac

SEQ ID NO: 465680 - DNA, 1552 bp, Homo sapiens
cacttcccaaccccgtgaccacatactagcggtgactcagctggcaagtaggggccaggactaatcaatcctgactgtggctgctggtatcagtctctgagcggccatgtggcaggacaccacttgggtacttgtcactctccattcttggggagtggccacccaggagaggtttgttgtaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttgaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacgtacttgattcagcaccggaagatcaacaccggggaaaaaccctacaagtgcagcgagtgtggaaagccttccggcacagttccaacatgtgtcagcatcagcggattcacctccgggaggacttctccatgtaacgtggcgcggtgtccgagggcagagtccagctgagcacttcttgcatgc

SEQ ID NO: 465681 - DNA, 1088 bp, Homo sapiens
cagcttttcctgaaaacccaaatgcgtagagaggaagaagctgctcccaatgctgcagacataggcacctcagaagatccctggcatgaggagttggctccttcaggaaatgccctcactttccgagtctggtcatgccacaggacagatagatgtgaggggaatggtgaggccctccagggccttgtggattcttgtaacatcattggcttttactccatgggaggagacaagccacaggctgcttatttttattattccattttgtcaattccaattaactcgttcatcttaatctcttcattattctttcactgtaatactagggattataacatatctcctccagtcattctggtctgccctaaattagagtcttgccacttcctggacaatgaggaaccatagagcactgtaacaccattaaacatttttcctggatagacgcatcatccctgtcacatcatctaattctacagatacggtaagccccacgggacattcttgttattgttttgtgtactcattaaatttaccaatgtattaaccctttctgtggctctccgttccttcttgcgcgtctacacttccatttagaatcatttttcttctgcccgaagaactctctttggtgttcattgtagtgcagatctgctggcaataaagtctgtcgattttcacttctctaaaaatgcctttatttcatcttcgctttcaaagcatatttttgatgggtataagattgtagacaggcaattatgttttttcagcagttgaatctatgtcattctgttatcttccacttccatcgatcttattgagaaattcgccgtttacttatggtttcttctttgaaggaaatgtatagtttttctctggttgtgtttaagatgttccctttgtctttcactcatggcagttttactatgatgtggtgaagtgtatctttccttgtttttattatgctaggagtgcttgaatctttgatttcacgtatttcactagctttggaaaatcctcagctaatatattttcatatagtgcttctgtagaatttgtttcctgttttgttttttgagacaggatct

SEQ ID NO: 465682 - DNA, 826 bp, Homo sapiens
cagttacgcttctgttcatttgtcatgagactgttttcttttacccccatgaacatgatggacaacaattgctttttcctgaagagacttagtaccctgtggctgagcttaagcgggactctagacagcattgattgcattttcttcttcctctacgaactgggatttctccttctgtttttctactgcctagaggtgaatctgtatttgtcaatatttaggttcaccttccagacacgctccaaaacagtccctcagaattgtcttgagatgaaacaaaaggtgatgaaggtccagaatgatgctcacccaggccagcgcacacagcacagtgacccgtgcacaggatgcactgagcacacacggcactgggtgaaccatgaacagaaggagaagccagcctgggtctgcaaaatatactttgcaggaaaagcagacacagtggagcagagcgtagcagctcctggtaggacgctcatgacccacatcactgaaccagataggagcagggaaaatatcccaagtaatagaacggcttgacttgacccttgggtcagatatgtctgtgtttcaatcagcattgtcaccttctaattttgtcaccttgaaaatatgattgtatttattttaacttcactttttcattaactgtaaattatgttttatcagtagagcttcaaagatttgaataatttttgctggattcttcaaacatgaagtattttttgaattgaaaactaactgaatgactaactggtgtccaagcctactcacaccaatcatggaaggagcctttgtcactgccagaagatatagagccttggta

SEQ ID NO: 465683 - DNA, 911 bp, Homo sapiens
  misc_feature (1)..(4): n is a, c, g, or t
nnnnttttagagaaaagacagtctgtaactgtgattaaagatggcatccttacgccttttcatttttgtcgtagataaaaagtgtccgtatgtgtggtttcttctgacaccaaccaattcttcagtaccagctggcacaatggtggagtggaaagtcccggaccttgttcccccacggactctgactgacaacaatatacagtccaaaaggatgtatgagaattacagaaaccagtttagaagtcacagtaccccaggcaagctcaaagccaagaacagctgcattgaacctgttgccctgccagacaacttgcagtgccacagacaagcaccagagggatcgagagattacaagcaactgaaaagaaactggcagacctctctaattgggacattccatgtacaagcccagagaagattcatccccagaaaaggtttgagaggccccagaatctctagctgagctgattggtgaagttcttctcctgtaccaagccagtccataaagactgggagaggtggctgttttttcagataccccaaatcccagcaaaaaaataatgagacatatgaagaaacagagaaatatggcccaattaatggaacaaaataaatctccagaatttgaccctagagaaacagagataaatgaattatctgacaaagaattcaaaatgatcatcttaaagaagcttagtatgctgtgagagaacagagatagtcaagcaaatgaaatcagaaaaaatgcaataacaagaatatcaacaacaagacagaactataaaaaaagaaccatacaaattctgcatctgagaaataactgaattgaaaaattaactagagggattaaaaagctgacccagtcatgcagaagaatcgtcaaactcaacagctcatttaaattcatcaaa

SEQ ID NO: 465684 - DNA, 1192 bp, Homo sapiens
aggctggccgtggcgcgccggaaggtgtagcggccctgggccccgccccggaagataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccacatccgagagatgcccctgctggccgcaagtgggtctcattgctgcccgcggactggacgtctccggggaaccagactgtgcggagaaagagaactagtgctgagggcctcaataaagtttgtgtttatgccacctggctgtgcccacccccatggtttcaaagggaggggtccctgctgggaggatttctgtgggatccccctggttggtactgggagggagttagactactgaagtagaccaccagaaacagaataggacacaatcgttgagcctggtgttctggaccataccctcactctgtcagctccctgctaactttctcagcacctgaggcagtcctttgcccagggtcttttagcgacaccctttccctccatactggctacagccctgctgatgt

SEQ ID NO: 465685 - DNA, 1016 bp, Homo sapiens
tctctccagttcagagttttctgggaaaccacattttaaaaatgggttggtgccagtttgggaaactgctgttctcagcctgtgctgcttctctctgcagagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcattttggtcacagcaatttaacaagcctctaggaagttccaaactcccttattttcccatcttctcctgagccctccaaactgttccaacctctgcccattatccagttccaaagctgctttcacattttcagtaattttaaaggtatactttataattattttaaaattttctcatgggagtgataaatgtaaaattttgattagatttactatatctgtattataatatattttcattattataataatataattatagattaccaattttgtaacatatttcaaattgaaatgtcaaaatataatttaaattataattacacattaaaatgttatttatggtattatattttatattatgcaccatattaaaatacaacttatttatattttacatataattaatttacttatgttttatgtttacacttaaggtaatatttaatatttatactaacatattaatattattttatattacactaattttcatattataacagtttttccattttcaaaatat

SEQ ID NO: 465686 - DNA, 1102 bp, Homo sapiens
gccagttaaaaagctgctgaacaccacacacagcgctggaatggcaaatgcgtctgcaatctggggagccttgtagagaattctgtctcacagtggacgatccagaaggtcatgatgcaccagtgaaggacgatgaagatcccaaagtacagctggaaaaccgaggcaaagagggcaaacgtgatgaccctggcggcgatggtgaagaagtgccagcagaactggatgatgacggccatgtagctgatgggcttcttgtcatctcgagagtcccggagggccttctggtaggaggccaaggcccaggccagggacacgagggaagctgccgctgtgaaacctacaaaggcaaacaggaagacagtgtgtcagaaatcagttgcagcaatgccccctggaatttgcacaggaagacgttacttaaggctgctttccaaagcagtgaaaaaataagtcagaacagctgtgctgatggctgggactctctcaggacagcttggaaggcccgacctggcagctctctgggcccaccggagctctcctgccttgtcttgtacctgcctctctgtgctccagccacactgccatctctccgtttctcaaatgctacgtaaagccgcattctcttcccacagatagaaaatgctgtgctcgcccttgaaaagcctctctctccaatgaattcccactcattcctcaattttcagttgaagcatcattcattcctttgggaaaccttttctagcccctaacaccctgcattggtcctaacataccttggcatgactgctgtagctctgtatctgcgtgggtactgacggatgtgactccaggagggagggtgtgcagcctgtggctcaccacggtatccccagcacctgtctctctgcttgcctattaacttcctaaattagtgcattttcccctgtcatttaaaaaaaaactttaattttttcatttgtatatatcgacagagcacaagtacagatttcttgcatgcctatgttgtattgtggtaaagtctgggcttctatgtgtacccatcactcaaatagtaaacattgtgcctgagaggtaatttttcagccctcacccccctcca

SEQ ID NO: 465687 - DNA, 3675 bp, Homo sapiens
  misc_feature (860)..(860): n is a, c, g, or t
  misc_feature (863)..(863): n is a, c, g, or t
gctccacggttatatactggatgcatgcttcatgctgaactaagtgctgaggtggagttgggggaggctgtttctgactgtcccactgggcccatcaaatttgcccacaattaccccctcccctatgggtgctttgtcttaggtctgttctgcttcaaaagactccaaccaaacattgaagggacatcttcctcagcaggtacccagccagatgtggatgagtgtgtggaggggactgacaactgccacatcgatgctatctgccagaacaccccgaggtcatacaagtgcatctgcaagtctggctacacaggggacggcaaacactgcaaagacgtggatgagtgcgagcgagaggataatgcaggttgtgtgcatgactgtgtcaacatccctggcaattaccggtgtacctgctatgatggattccacctggcacatgacggacacaactgtctggatgtggacgagtgtgccgagggcaacggcggctgtcagcagagctgtgtcaacatgatgggcagctatgagtgccactgccgggaaggcttcttcctcagcgacaaccagcatacctgtatccagcggccagaagaaggaatgaattgcatgaacaagaaccacggctgtgcccacatttgccgggagacacccaaggggggtattgcctgtgaatgccgtcctggctttgagcttaccaagaaccaacgggactgtaaatgtgagataattgggatggcagtgacatgcaactatggtaacggcggctgccagcacacgtgtgatgacacagagcagggtccccggtgcggctgccatatcaagtttgtgctccataccgacgggaagacatgcatcgntgngtgagacctgtgctgtcaacaacgggggctgtgacagtaagtgccatgatgcagcgactggtgtccactgcacctgccctgtgggcttcatgctgcagccagacaggaagacgtgcaaagatatagatgagtgccgcttaaacaacgggggctgtgaccatatttgccgcaacacagtgggcagcttcgaatgcagttgcaagaaaggctataagcttctcatcaatgagaggaactgccaggatatagacgagtgttcctttgatcgaacctgtgaccacatatgtgtcaacacaccaggaagcttccagtgtctctgccatcgtggctacctgttgtatggtatcacccactgtggggatgtggatgaatgcagcatcaaccggggaggttgccgctttggctgcatcaacactcctggcagctaccagtgtacctgcccagcaggccagggtcggctgcactggaatggcaaagattgcacagagccactgaagtgtcagggcagtcctggggcctcgaaagccatgctcagctgcaaccggtctggcaagaaggacacctgtgccctgacctgtccctccagggcccgatttttgccagagtctgagaatggcttcacggtgagctgtgggacccccagccccagggctgctccagcccgagctggccacaatgggaacagcaccaactccaaccactgccatgaggctgcagtgctgtccattaaacaacgggcctccttcaagatcaaggatgccaaatgccgtttgcacctgcgaaacaaaggcaaaacagaggaggctggcagaatcacagggccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacagccagctgtgggctgccctgcctccgacagcgaatggaacggcggctgaaaggatccctgaagatgctcagaaagtccatcaaccaggaccgcttcctgctgcgcctggcaggccttgattatgagctggcccacaagccgggcctggtagccggggagcgagcagagccgatggagtcctgtaggcccgggcagcaccgtgctgggaccaagtgtgtccagtgctccccagggcactactacaacaccagcatccaccgctgtattcgctgtgccatgggctcctatcagcccgacttccgtcagaacttctgcagccgctgtccaggaaacacaagcacagactttgatggctctaccagtgtggcccaatgcaagaatcgtcagtgtggtggggagctgggtgagttcactggctatattgagtcccccaactacccgggcaactacccagctggtgtggagtgcatctggaacatcaaccccccacccaagcgcaagatccttatcgtggtaccagagatcttcctgccatctgaggatgagtgtggggacgtcctcgtcatgagaaagaactgtgggtggcttgcagagctgggccagggaagggcagtccaaatctggttaaggcggagaacaaagagagagactgatacaggaagaaatggggcagtgaagttagggatctatgagggtgaaatagtgagaggcctttaggaagagagaagctaacaaaggaaaacagcaatgacacatgtttggtagaaaacagagttaagaaagctagcagtggggctagaactccaatggcgttacatgtatcactttcctatcctagcatttttgccattccattcatttaaatgtcatatttattacactatgtgagtgcccagccggcagccccctaccctcagacaaggaactctctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgccaaaaaaaagaaaacagaaagaaaaaatgtatcatctaaaggactagacacagaacaattggaagtcaacttcaaacactaatcccttttcttgtcttccctggcccagccacctcctcagccccatgtgatgctccctgggggagccctactccccttgctacatgttgtccttaaacatggttattgacctgaagccagcct

SEQ ID NO: 465688 - DNA, 433 bp, Homo sapiens
agtgagaggcctttaggaagagagaagctaacaaaggaaaacagcaatgacacatgtttggtagaaaacagagttaagaaagctagcagtggggctagaactccaatggcgttacatgtatcactttcctatcctagcatttttgccattccattcatttaaatgtcatatttattacactatgtgagtgcccaggtatcaaggaggaattgtggaatgagcccagtgggcaatgggagagggtgtggggtagggtgtgtgtatgcgaagggggagcctttgtcagaatgattctcttgccctatacccccaccaccagctgtacagcccacgttctaggagggcttgggtagcctgccctgctgctctactgacctgctgcttgccttcccagcatccccatcctccattaccacttatgagacctgccaga

SEQ ID NO: 465689 - DNA, 2497 bp, Homo sapiens
  misc_feature (860)..(860): n is a, c, g, or t
  misc_feature (863)..(863): n is a, c, g, or t
gctccacggttatatactggatgcatgcttcatgctgaactaagtgctgaggtggagttgggggaggctgtttctgactgtcccactgggcccatcaaatttgcccacaattaccccctcccctatgggtgctttgtcttaggtctgttctgcttcaaaagactccaaccaaacattgaagggacatcttcctcagcaggtacccagccagatgtggatgagtgtgtggaggggactgacaactgccacatcgatgctatctgccagaacaccccgaggtcatacaagtgcatctgcaagtctggctacacaggggacggcaaacactgcaaagacgtggatgagtgcgagcgagaggataatgcaggttgtgtgcatgactgtgtcaacatccctggcaattaccggtgtacctgctatgatggattccacctggcacatgacggacacaactgtctggatgtggacgagtgtgccgagggcaacggcggctgtcagcagagctgtgtcaacatgatgggcagctatgagtgccactgccgggaaggcttcttcctcagcgacaaccagcatacctgtatccagcggccagaagaaggaatgaattgcatgaacaagaaccacggctgtgcccacatttgccgggagacacccaaggggggtattgcctgtgaatgccgtcctggctttgagcttaccaagaaccaacgggactgtaaatgtgagataattgggatggcagtgacatgcaactatggtaacggcggctgccagcacacgtgtgatgacacagagcagggtccccggtgcggctgccatatcaagtttgtgctccataccgacgggaagacatgcatcgntgngtgagacctgtgctgtcaacaacgggggctgtgacagtaagtgccatgatgcagcgactggtgtccactgcacctgccctgtgggcttcatgctgcagccagacaggaagacgtgcaaagatatagatgagtgccgcttaaacaacgggggctgtgaccatatttgccgcaacacagtgggcagcttcgaatgcagttgcaagaaaggctataagcttctcatcaatgagaggaactgccaggatatagacgagtgttcctttgatcgaacctgtgaccacatatgtgtcaacacaccaggaagcttccagtgtctctgccatcgtggctacctgttgtatggtatcacccactgtggggatgtggatgaatgcagcatcaaccggggaggttgccgctttggctgcatcaacactcctggcagctaccagtgtacctgcccagcaggccagggtcggctgcactggaatggcaaagattgcacagagccactgaagtgtcagggcagtcctggggcctcgaaagccatgctcagctgcaaccggtctggcaagaaggacacctgtgccctgacctgtccctccagggcccgatttttgccagagtctgagaatggcttcacggtgagctgtgggacccccagccccagggctgctccagcccgagctggccacaatgggaacagcaccaactccaaccactgccatgaggctgcagtgctgtccattaaacaacgggcctccttcaagatcaaggatgccaaatgccgtttgcacctgcgaaacaaaggcaaaacagaggaggctggcagaatcacagggccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacagccagctgtgggctgccctgcctccgacagcgaatggaacggcggctgaaaggatccctgaagatgctcagaaagtccatcaaccaggaccgcttcctgctgcgcctggcaggccttgattatgagctggcccacaagccgggcctggtagccggggagcgagcagagccgatggagtcctgtaggcccgggcagcaccgtgctgggaccaagtgtgtccagtgctccccagggcactactacaacaccagcatccaccgctgtattcgctgtgccatgggctcctatcagcccgacttccgtcagaacttctgcagccgctgtccaggaaacacaagcacagactttgatggctctaccagtgtggcccaatgcaagaatcgtcagtgtggtggggagctgggtgagttcactggctatattgagtcccccaactacccgggcaactacccagctggtgtggagtgcatctggaacatcaaccccccacccaagcgcaagatccttatcgtggtaccagagatcttcctgccatctgaggatgagtgtggggacgtcctcgtcatgagaaagaactcatccccatcctccattaccacttatgagacctgccagacctacgagcgtcccattgccttcactgcccgttcc

SEQ ID NO: 465690 - DNA, 2914 bp, Homo sapiens
cctctctttctctctctctctgtctctctctctctcgtctctcttcctttcccccctccaccacttgggacctgagcgagaggactgcagcaggcgagttccggaaggctgaatccccaggtcccagccccggaccgcggcaactcgcccctgcggcaccgccggcccggctgcgcccccactcagcgatggaggtaaagaggcggcggccgcgcgccctgccccggctgccgctgccgagtccccgctgctctcctttccccttcagtttcctgggcgaagcagagggcgacatgggtgggtgggttgctgcgctggggcgaggtggggtcgatgttgttttttcattgtctggagctgcaggggaggcgaggcgcggggaaaggggcgaggggagccggggtaattaacacgggggaggcacccctccgtctcccacttccacccacacccccatccctccaccccctccgctttgcaggaaaaagcctggatgcgaaaggatgggggagaacaaagagcctttggaagacgtcgctgttatctcattgtctgtgtgattgggggagctgcggcggggaggatgctgtggtcccttcctccggcgttccccacccccatccctctccccgctgtcagtgcgcacgcacaacgcgccgctttttatttctttttcctggttttcttattccatcttctacccacccctcttcctttctttcacctttccttccttccttcctcctttccttcctcaggagaaaggcctctctctccgtgttcacagcggaccttgatttaaatgtccatacaattaaggcacgcggtgaatgccaagaatggggctggctgagcaccgtgggtcggcgagggcccgccaaggaaggagcgaccgaccgagccaggcgccctccgcagacctccgcgcagccgcgggcgcgaggggaggggtctggagctccctccggctgcctgtcccgcaccggagcccgtggggtggggaggtgtgcagcctgtgacagacaggggcttagagatgcaaagagactcagggagagaaacagaagctgattctgtgacagaagcagatctgtgcagcacagatgcggctcttcatttgccctcctaaagcagtgtttagagtcaggcagaggttaagtgtgttgcacctcacctagatacttccagaaccttctctgggtctgcagaatgtggcacaacctgcttgcccccgcagagagaaagctgcagtgcacatcctgcagactgcaggtgctgggctgcctctggagtcccagaaggcaagcttggctgcaggacagaaagggagaacagcttctctcacccctgagccttcacaagcccttgtctatttgccgttgccttcaaaatatacctcccccgaaaccagtagctttctgagtcctggtgtcccctccgccctttctggacaggtttgggaagaagaaagcagtcagtgctgggccttattggggtgtgaagcgccttgctctgccccttctgctcactgtgaaggccgctggatgcttctcttaggcatggtttaagcctccgattactaaaccccttgccccacaaacgtccacattgacgagcctctttttagtaactgcttccccgtaattccttcagaggttgctgtacccttcgctgatgtgctgccctcctgtaaaacctccagatgccttcccacgtaatgcccctttcagatgctttaagctgagagcttaaaccacaggtaccatggctgacgcctgccaggtttctgctgcagataatctatgatgggaggggcatattttttacttcattacttatgtaaactcttgttccagaaagctttaatgtgtgtgggagtgttctgggtctattaggtctgtgcgcatgggtgtgggcatttgcctgtgtccaccgggtgggtctcattatgaaatgtatgtttatgtagggctttaatggctgaaaatggcaaagagatgaatagaccacttggccccatgtgtaattgccaggccccttctgtgctcaaatgaggtgtccgagtgaaggtcagcccttcccttctgtatttggggcctatttatgccaccagtaattttataagaaatctgaatagttctcccctttgagtgcatttaactctttagtatcttctctcttacctatttgagcccctctagctacagtctggcttaaatgaaaggggaattatatgcttaagaaaaagtaggacacggttgaggcagtttgctgactgaatacgcgaagaaggacctgatgggctcatatgcaccactgccatcacagtccccatcgtgatgcaagcttatatgattcttgagaaacagcccagatctcctcttaagcggaaaagagattgaccttctagcagaggcaaagaatggagtcttctgggggcagctgcaaagcgttctccctaggacagatggagcctccctttcctcatctactctgtgggtggtttcagggcccacgagtcaacatgaggagttgtgctggtggtatgtgtgttggaggctgggctggctgattcacagtgacgaggatgtcaataataacaagaatgagaatgatggtacctaataaagactttttttcccaagtcccatctacaattctttcattgggtgttttgccaagtctttctcaatctcatctcagctttttttttttttttaaagaaaatgtattcaatacttaattgcatcacaaatgtagacatagaagaaaggacttcaaacggaatttatgggaggcaatgtgtgcggctttttgccttatagagctgtgtagaaggtctggaatgatcttccagcaccaaatttagatggcctcaaaaaaaaaaaaaaaaaaaaaaaaatcaggccttatt

SEQ ID NO: 465691 - DNA, 1835 bp, Homo sapiens
ggaattttgcttttagacttttactgggcccaggacagcaccttgtctcatttgaacaagacatctggagcctggagatcccagggctgatatggcaacagtgcgatgccccccatggatatggggtcgttccatgtttcttccctgccttcctcagcatgttaacctttcagcttcacatccgcatcctcatggtcacaagatggctgacaagctccagctctcccatccctagaaagacttcagctggcaaagcaacgcaaatggctgagcgtcgaggatagaagtggctgaacagcgagcagagaagcaactgagcatcggaggttggagatagatgcagctaacttcagatactgtggttttagagaggggcctggccagagacggctgggttccagggacagaccaccttcccatcccctttccagcctccctttccactgagagctgctcgctgctcaataaagtcttctacattcatcacccttcaaacagttcatgtgacctggttcttcctggttcgtcggacaagaacccgggtgccaagagggcaagggctgtcaccctgaccctccactgagtcggttggtacttggccatccctggacagcagagctgaaagagcatgggttgtaacacgcttggactctactgcggggtctgcacagagtctgctcccgccagagaggagcagccggacggttccagcatgaagacttacgccagtcatcgccagccacttgcccagctaggctcctgcggcagtcaaaaccccatcctcatgcctaggaacctgctgagacttaccagaggccaccaggaccgagaggagctgtgggtccacccacccttcctccctcccgctctctgtcctgggaggctgatacatatgtaccacagcatggcccttgtggcctctggcttctgggtgtggctgctgggggctttgcaggcggctgcgggagggcagggagttgacatcacagactgtgcctacttttgcatttctgaagaccggatgactctgcctggacccgagacttgtgacccactgggtcctgtggccccacccacaagcaaactcaacacaccaggaccatttcccacacccctatgattgcatccccaaccaatcagcagcacccattccctaaccctcttcccacaaactatccttgaaaatccctaagccctgaatttgcagggaggctgatgtgggtcataatacaactccagtctcagctggctctgcatgaattaaacattcgctattaccattctcctgtcttgataaatcagctctatctgggcagccagcaagatgagcctgtcgggtggttacactacttagatttaaatatcaacatattcagctaaaagagttgaaagcaattgcccgagtgtggaaaaaagggggggagggcaaagagagtgagaaaatgcttttttagtaagaaaccttatagaagtatttgctaatctgtttgtacatcccttggattaaataaatagaaaaaaaaaaaagattgaagtcatctgtgaagtggctctgcagccagtcttgtcccttcctcctaggggatgggcagcagctcagatccagggccctcttctccatcttcctccccctcctccctcctcatacacagtctgactgcagcttcccagctggagcagaaagcaaaagagaagtgattgtacctaatcacctaggtcattttctcagaaattgctttctttttcaccttttttcatgaggaacaaaaaggaacaggagaggcagcccaattgctgttcctgtgagctccggctctccgcagggggctggcctg

SEQ ID NO: 465692 - DNA, 862 bp, Homo sapiens
ggctggagagtgatggagcaggaggagcccacatggaggagtgacagcgtagacacagaggacagcggctatggaggagaggctgaggagaggcccgagcaggatggagtgcaggtggctgtggtcaggatcaagcgccccttgccctcccaggtaaacagatttacagagaaactcaactgcaaagcccaacagaaatatagcccagtgggcaacttgaaagggagatggcagcagtgggctgatgaacacatacaatcccagaagctcaatcctttcagtgaagagtttgattacgagctggccatgtccacccgcctacacaaaggagatgagggctatggccgccccaaagaaggaaccaaaactgctgaaagggccaagcgtgctgaggagcacatctacagggaaatgatggacatgtgcttcattatctgcacaatggctcgccacagacgagatggcaagatccaggttacttttggagatctctttgacagatacgttcgtatttcagataaagtagtgggcattctcatgcgtgccaggaaacatggactggtagactttgaaggagagatgctatggcaaggccgagatgaccatgttgtgattacgctactcaagtgaaccttcaaaaacaaaagccaaatttggcccactatggtcttaatgctaaatgctcatgtaggtaaaatgaaaatgcaaactctctgtaataagttagtaaatattaaacaatttttacataaacgactttctggcattctatttctatctagaatgaggaattttggagattttgagaaggcacaaagcatttcagaaagcacatagaatgttaatgtataataatagtatt

SEQ ID NO: 465693 - DNA, 1935 bp, Homo sapiens
tttgggtgagaagtgcggcggcttttcccagggatggagtttagaggacgctaatcctatgtgtgagcggcggaccccgcccggacttcccggaggcgcccggttagtgaggcgacggcgcccacccgcgttcgcgggctcccggccgccactccccggagccgccggcccgccccagccccgcgcgtcgcccgggagggcgggctgcactccctccacgtacctggctggcagagcgtctccagggacaaaaggtgccctgggatcaaagccgagcccccgcccccgcggggatgctgccctccggaaggaggggcgctgcccccaagatcccagactgcttgggaagttggacatgcatattcccaaagagaacagtgttggaagaagacaggagagcagctcgcgggttgggggtagagggtaggaaaagagggcaagatggaggactaccactcgaggccagcctccactgcctgttagggcggtagaacctaagagccggtccaaggcaacacaaaagacagtgaggctaggtctttaattgcagccaacgatcaagaaagcaactccatcaaatgacactgtctttttaaaaaaaattttttttttttgagacagaagcgagactccgtctcaaaaaaaataattattatttaaaataatcattgggcctggcgcggtggctcacacctgtaatcctagcactttgggaggccaaggcgggtggatcacgaggtcaggagattgagatccagcctggccaacatggtgaaaccccatctctgctaaaaatattttttaaattagctgagcgtggtggtgggcacctgtaatcccagctagtcgggagactgaggcaggagaatcgcttgaacctgggagtcgaaggttgcagtgagccgaggtcgtgccactgcagtccacctggccaacacagcaggcctctctctaaaataataattattattattgttattcttgacaggccagtgtagaacaggtggggcatctgtggtatgacagaactgggttccaattctgtcccttcacctgtcccaggttcctcatctgaaaactgtgacccagtaaacctaatttcatgagcagctttcattaaaattgaaataatgttggaaaatgccttgtaaccgtgcttgatatagagtagttacttagccagttatttcctctcttcttccaattcctaacaaaatggaaaaacgtttggttgctaggaaagagctctaaggggattttgttgttgtttgagacaaagtttggctctgtcgcccaggatggagtgcaatggcacaatctctgctcactgcaacctccgccatagacaggagccaagcatagtggcgtgcacctgtctgtagttccagcctcttaggaggctgaggcaggagggttgcttgaggccaggagtttgagtctagcttgggcaatatattgaaaccttgtctcttaaaaaaaaaaaaaaaagaggccaggtgtagtggctcacgcctgtaatcccagcacattgggaggccgaggcagtggatcacttgaccccaggagttggagaccagcctgggcaacatgcaaacttccgtcttctaggccgggcgcggtggctcaacacctgtaataccagcactttggtaggccgaggcgggcagatcacgaggtcaggagatcgagaccatcctggctaaggtgaaacccagtctctactaaaaataaaaaaaaaattagccgggtgtggtggctggcacctgtagtcccggctacttgggaggctgaggcaggagaatggcatgaacccaggaggtggagcttgcagtaagccgagaccgcaccactgcactccagcccaggcaacagagctagacgccctctcaaataaaagtaaataaataaataaaattatgtcattaaaaaaaaata

SEQ ID NO: 465694 - DNA, 764 bp, Homo sapiens
cctatatttggagagggctctttatgttaaatctcaaattccttatgaaaataattcattttatgcaaataattaggacaaatataatggaactgaaacttgttttgcaaataaattggtgctgctgtgatttgtctttggtaaaaatagggaactggagagagaaaaattatgtctcaagtaaaaaactatattatacctgttgttggattccaactcggtctattgtttttgagtctctactggtgacctcaaatctgatttgttttcaaggtcattcagcggcatcactcaaattttcaggtgtccttcaaaaatgtcatgtgctcataaacacttcaaattctcagtggttctttctgaattataaactccatgaagacccaattccatcagcagccattggaagtttttgacaaaatgggaagatcactgctgtatatttgtagtttaaatagcgagcatttaaagctttctctgaggcagtttctggaaagttaaagactaatgagaaaaacagctgaagaaactctccccaatgagtttatgtccctaagcgatgaatttttgaatggtgcaatgttctaacatgtgatggacagcgaattcccagagaatcatcaagtacactttggaataaatgaacagcaggacatattttttaaggagtgctgagccgcagtaaaactccagagaatgctctaatttcttgatttatttcctggatttcctcctaataaacaaagaatgatgaaagcaaatat

SEQ ID NO: 465695 - DNA, 1795 bp, Homo sapiens
cctcttcaggctttgtggttctgcagcatctgggcccgccaaggactctctctcccattcacccaaacaacagatgctcttaaggaatggtaccagctcctccttgtacctctggtacctctgtgaatccatctggtcctggactttttttgattggaccctcagctgcaggtctgttggagtttgctggaggtccactccagaccctgttttcctgggtatcagcagtggaggctgcagaacagcaaatattggtgaacagcaaatgttgctgcctgatcgttcctctaggtggagtctacagaggcaggcaggcctccttgagctatggtgggctccacctaattcgagcctcctggctgctttgtttacctactcaagcctcagcaatggcaggcgcccctcccccaacctcgctgctgcgttgcagttccatctcagactgctgtgctagcaatcagcatggttccgtgggcatgggaccctccaagccaggcacgggatattatctcctggtgtgctgtttgctaagaccatcggaaaagcacagtattagcgtgggagtgacctgattttccaggtgccgtttgtccccccttcccttggctaggaaagggaattccctgaccccttgtgcttcctggctctgtcccatcagcttcctccacagagcctgaaccggcaccagctccactctgcaggaaggaggatgtggaaatgaagaggcaggctctgatgactcaacacagccacccaaacaggcaatctccctgggacttgctcaggggatttttacccccctacatgaagcagagaaacagtgagtttcctccaagatgtcaaatccaagatgggtgttcctgatctgcctgtagctctcctccaacccagactcctttcaaactgtggctccaccatcttcaatatggagcttccaagatcgccctgctgccctgcatcaagcctgcaaaagaggatagggggtcaggccactcatatttcattggcccaaattcagtcacatggccacactcactgcaagggaagctgggaaatggagtctagctctgtgcccaagaagcaaagaaaaacagatttgatgaagacttagtcaatctctgcaacaatgaaacagataagaaggcaaaagaaaaagaattttacaacctgaggagggagagaaaattcagttaacaaaaagatagactacatgccaaggtagtctgcagaattctacctacccaaattatgtgttaaattgtgaaagaagttatgataaaaataggatgagggtgaaatttgaaaaatgctctggggacacatagcacactccttccctggtgacacagtaggcagaaccaagccaactataaaaggaagctcagtgtgtttaatctgttgctcggataaaaccatcctggaaaaactcccagttttacaatctaactgatcatcagtatctcagttatacaaataactccagcctgcatgaaataccttcttgctccccttgacttgtaaaaataactttgtttcaatggaaaaggtgtagaaaatggacgttgaagccaatcaaactcatagtatcaatactttgtgttaagctttaggagtaagttttgtaatcattgcaatcagcttgtttttgttatttaagcagcttaaaatgattaagataatctgacatattagccttacgattttattttggaatgataaactaatactcaatttgtaattttcacttgaaagttgcagaataattgaatatgttctttaaaagtgtttgaatatt

SEQ ID NO: 465696 - DNA, 1089 bp, Homo sapiens
ggggattgggcagtgcaccagaagaatctaccacattcccgaggtttacttcaagatgcaattgggcctgcctgtcaagcctttgcagtaaacattccatgcatatctaatgagtgacacaaacacagcttggtcaaatccaagatgggtgttcctgatctgcctgtagctctcctccaacccagactcctttcaaactgtggctccaccatcttcaatatggagcttccaagatcgccctgctgccctgcatcaagcctgcaaaagaggatagggggtcaggccactcatatttcattggcccaaattcagtcacatggccacactcactgcaagggaagctgggaaatggagtctagctctgtgcccaagaagcaaagaaaaacagatttgatgaagacttagtcaatctctgcaacaatgaaacagataagaaggcaaaagaaaaagaattttacaacctgaggagggagagaaaattcagttaacaaaaagatagactacatgccaaggtagtctgcagaattctacctacccaaattatgtgttaaattgtgaaagaagttatgataaaaataggatgagggtgaaatttgaaaaatgctctggggacacatagcacactccttccctggtgacacagtaggcagaaccaagccaactataaaaggaagctcagtgtgtttaatctgttgctcggataaaaccatcctggaaaaactcccagttttacaatctaactgatcatcagtatctcagttatacaaataactccagcctgcatgaaataccttcttgctccccttgacttgtaaaaataactttgtttcaatggaaaaggtgtagaaaatggacgttgaagccaatcaaactcatagtatcaatactttgtgttaagctttaggagtaagttttgtaatcattgcaatcagcttgtttttgttatttaagcagcttaaaatgattaagataatctgacatattagccttacgattttattttggaatgataaactaatactcaatttgtaattttcacttgaaagttgcagaataattgaatatgttctttaaaagtgtttgaatatt

SEQ ID NO: 465697 - DNA, 1052 bp, Homo sapiens
ggggattgggcagtgcaccagaagaatctaccacattcccgaggtttacttcaagatgcaattgggcctgcctgtcaagcctttgcagtaaacatgtcaaatccaagatgggtgttcctgatctgcctgtagctctcctccaacccagactcctttcaaactgtggctccaccatcttcaatatggagcttccaagatcgccctgctgccctgcatcaagcctgcaaaagaggatagggggtcaggccactcatatttcattggcccaaattcagtcacatggccacactcactgcaagggaagctgggaaatggagtctagctctgtgcccaagaagcaaagaaaaacagatttgatgaagacttagtcaatctctgcaacaatgaaacagataagaaggcaaaagaaaaagaattttacaacctgaggagggagagaaaattcagttaacaaaaagatagactacatgccaaggtagtctgcagaattctacctacccaaattatgtgttaaattgtgaaagaagttatgataaaaataggatgagggtgaaatttgaaaaatgctctggggacacatagcacactccttccctggtgacacagtaggcagaaccaagccaactataaaaggaagctcagtgtgtttaatctgttgctcggataaaaccatcctggaaaaactcccagttttacaatctaactgatcatcagtatctcagttatacaaataactccagcctgcatgaaataccttcttgctccccttgacttgtaaaaataactttgtttcaatggaaaaggtgtagaaaatggacgttgaagccaatcaaactcatagtatcaatactttgtgttaagctttaggagtaagttttgtaatcattgcaatcagcttgtttttgttatttaagcagcttaaaatgattaagataatctgacatattagccttacgattttattttggaatgataaactaatactcaatttgtaattttcacttgaaagttgcagaataattgaatatgttctttaaaagtgtttgaatatt

SEQ ID NO: 465698 - DNA, 1132 bp, Homo sapiens
cggccgagagctccaccgctgaggccaacgaggccacgcatttatttttagcaccaactttaaggatttttattatgacaatagaggttaatgagcattttcacaagataaacaaaaaatccccccaaatatgtaagtgttttaacataatgattgcagtttatttttcactcaggtcaaatccaagatgggtgttcctgatctgcctgtagctctcctccaacccagactcctttcaaactgtggctccaccatcttcaatatggagcttccaagatcgccctgctgccctgcatcaagcctgcaaaagaggatagggggtcaggccactcatatttcattggcccaaattcagtcacatggccacactcactgcaagggaagctgggaaatggagtctagctctgtgcccaagaagcaaagaaaaacagatttgatgaagacttagtcaatctctgcaacaatgaaacagataagaaggcaaaagaaaaagaattttacaacctgaggagggagagaaaattcagttaacaaaaagatagactacatgccaaggtagtctgcagaattctacctacccaaattatgtgttaaattgtgaaagaagttatgataaaaataggatgagggtgaaatttgaaaaatgctctggggacacatagcacactccttccctggtgacacagtaggcagaaccaagccaactataaaaggaagctcagtgtgtttaatctgttgctcggataaaaccatcctggaaaaactcccagttttacaatctaactgatcatcagtatctcagttatacaaataactccagcctgcatgaaataccttcttgctccccttgacttgtaaaaataactttgtttcaatggaaaaggtgtagaaaatggacgttgaagccaatcaaactcatagtatcaatactttgtgttaagctttaggagtaagttttgtaatcattgcaatcagcttgtttttgttatttaagcagcttaaaatgattaagataatctgacatattagccttacgattttattttggaatgataaactaatactcaatttgtaattttcacttgaaagttgcagaataattgaatatgttctttaaaagtgtttgaatatt

SEQ ID NO: 465699 - DNA, 600 bp, Homo sapiens
ttggcttagggctcgctgatgacaggccacttctattctgtccctgaagtgtcagctcctggccaggcggtggggcaggccccacttcatgctggttctgtggctttgaactcacgagcctgccacccttcagagggctctgagcgggctgtgtgccgggcgagaacactgcctgggccggggccactgtggcatgagaagggccgcctgggggcccggggcctagagcaggcggtcatgactctgtgggtcctgccatcctcccgttttggaagtgaggagactggggtcacattgatggggttcaggtcacgcagcagtaagtactggatcctggattcagacctggtggtgcctccaggttctagaaccttgactcgtgtggctcctggtctggttgttggaccccaggcccggaaggacgccttagtagagtgtgggctgcattgtcactgcaacaggttgctgaagacatgaggagagtagcttgcattcctttgccataattatgcaaacgtgcaggacttttaggggacctctctgaaatagagcaaacttcattagggaatcaaaggaaaagattggctcagaatttagtgg

SEQ ID NO: 465700 - DNA, 290 bp, Homo sapiens
aaacgcatttattcccaataataatcattagtgtattcagataggtatatgtgtttcaggtttgtgatatagtaggaagaagaatacccttctttgttaaggtgcttgtttttacacccagcaccaaatccctcccaggcttctgccagccccactcagtcttagttccaatactaatggtctattatttactcccaaactcccttacatctattcaattagtccttcagggagtcgttggttcccgaagcaagggggtaaccggagctcgaaatttcgtacatcatggt

SEQ ID NO: 465701 - DNA, 1807 bp, Homo sapiens
aaacgcatttattcccaataataatcattagtgtattcagataggtatatgtgtttcaggtttgtgatatagtaggaagaagaatacccttctttgttaaggtgcttgtttttacacccagcaccaaatccctcccaggcttctgccagccccactcagtcttagttccaatactaatggtctattatttactcccaaactcccttacatctattcaattagtccttcagggagtcgttggttcccgaagcaagcagatatgcagcttaatccaggactagttaacgttcctggcgtcagcagactcaggagggagctgaacacctgtgtgtatccagcagcaagaagactgaatgaagaggtacagtaccatactactccactttcccccaccatggtgtcagcaggggatggtgggaagctgagccttcatcttcatcagcaaactaacactggaacagaaaaccaaataccatatgttctcacttacaagtgggagctaaatgatgagaacacatggaaacatagaggggagcagcacacactggggcctactggaggttggaaggaggcttcaggaggagcatggccctgccaagaccttgactttggagccactagactccagatctgtgagagaacaaatttctgccactttaaacctcccagtttgccctatttgctacagcagccttagcaaactaatacaaaaatagtgatatttaatgaatggcataggaaaatgtttattggaaaagtaattgagacttcaggaatatgggattatatgtttttataggaaacagattagggcattagaaaatgtttctttaagggaacaagataaattaggccaaatcagaccacactttgactaagatagataaacaaagagatacttgatataggcctagtctctacataaaagtgaagtggatataaatgtgaataattaatttattacatgacaaagacggtaaaaggagggaaaagaaaaaaaaactgttccatagacacatgcctttttgattaagactgataattctcagagcttgtctaccaagcaatctggcttaaagaaagcactaatggattttttcatgtagaagtgtattcatgttggaaaaggtgttgtaagcatagtactgaatatattggaatttttgaaaaacctatgcaactgtaattgctcagtgttttatgcagggcaatgtgtaattgctgtcttttgtttatttttagataaaagatctgcagctatggaattcttctccatgacattttcacagaacatactacttgtgatttatatcatgtccttactcaagggttatgtgagtcttcatgtgttaggtgagtctcttgaagatgacagatacttggttggtggatttttattcattctgcaattctgcatcttttaagaggagcatttaggccatttacattcaatgttagtattgaaatgcgaggtactgttctagtcatcatgctagatgctgcctgaatatggttttttttttcattgtgttattgttatatagatcctgtgaaatttatgctttaaggatgttctattttggtgtatttcaagattttgtttcaagatttagaaatccttttagcatttttttttgtgatgctggcttagtagtggtgaattctctcaggatttgtttgtctgaaaagggttttatctcttcttcctttatgaagcttaatttcacaggatacaaaattcttagctgataattattttgtttaaggaagctgtattagtctgttttcatactgctgataaagacat

SEQ ID NO: 465702 - DNA, 326 bp, Homo sapiens
ttggggtgtattaagaaaaacagctctgtggaagtttgagtgactcattgcagagaggaattgatgaagtcaacagctgctggaaaaacttctttttccttaatagctgtatcaacatgtggttgctattattcaagtaagaaaaatatgtatatcaaacatccatggtagtccttgctaaaattttcattagagagactcatgttttgacattaaaaaaagttcaaatgggtaccttagaggatgttttgttggagaacaaaatcatggagaaataaagtctaaaaagaaaaataaatggcaagcatgttgttaaaaaaaaaaaa

SEQ ID NO: 465703 - DNA, 953 bp, Homo sapiens
aggaaaagctaaggatgtggaaggcattgaaattcaaacatgggaagtcaagaagaggaaactcggacaaatgccactggaccgtctgttatctcttgacgtcttttccagttgtcgtagaacctctccaaggtactaagaaagtagaaacatccacactttggatggttaactcaacattgacattgatttttgagacattgacattaacattgatttttaggcaaaataatggaaactaccaggcccctagtgccacagactcttctcacaaccctgggtttgagtacttcctacaaaccaaatattgtatagtagtcctggaacatggcctatctataatcaagaaaaccaggtgttacaaaggtctaatttccgatacattgaatacatctgggtctttagtccaggaaagaatcacctccaagattaacttcctcttccttccacagccccttgactgggcaaacttcaaacaagtgactgagctcccttagctgccactgattggaccaggatggacaacaaatgtaggaggagttcatctggatctagcctgagccagtcagatatcccctttgaatccatgcctatagaaatacaaaaaaatggaagccagaggatgatggatccttgaagtaataagtcagctctgtggaagtttgagtgactcattgcagagaggaattgatgaagtcaacagctgctggaaaaacttctttttccttaatagctgtatcaacatgtggttgctattattcaagtaagaaaaatatgtatatcaaacatccatggtagtccttgctaaaattttcattagagagactcatgttttgacattaaaaaaagttcaaatgggtaccttagaggatgttttgttggagaacaaaatcatggagaaataaagtctaaaaagaaaaataaatggcaagcatgttgttaaaaaaaaaaaa

SEQ ID NO: 465704 - DNA, 1152 bp, Homo sapiens
aggaaaagctaaggatgtggaaggcattgaaattcaaacatgggaagtcaagaagaggaaactcggacaaatgccactggaccgtctgttatctcttgacgtcttttccagttgtcgtagaacctctccaaggtactaagaaagtagaaacatccacactttggatggttaactcaacattgacattgatttttgagacattgacattaacattgatttttaggcaaaataatggaaactaccaggcccctagtgccacagactcttctcacaaccctgggtttgagtacttcctacaaaccaaatattgtatagtagtcctggaacatggcctatctataatcaagaaaaccaggtgttacaaaggtctaatttccgatacattgaatacatctgggtctttagtccaggaaagaatcacctccaagattaacttcctcttccttccacagccccttgactgggcaaacttcaaacaagtgactgagctcccttagctgccactgattggaccaggatggacaacaaatgtaggaggagttcatctggatctagcctgagccagtcagatatcccctttgaatccatgcctatagaaatacaaaaaaatggaagccagaggatgatggatccttgaagtaataagtcagctctgtggaagtttgagtgactcattgcagagaggaattgatgaagtcaacagctgctggaaaaacttctttttccttaatagctgtatcaacatgtggttgctattattcaactgccatgttgtgagttgccctgtggagaggcccatgtggaaaggaactgagagagggctctggctaaaaccactgagacacggaggccctcagtctgacagcctaagaggaactgaatcccgccatcggccatgaactggagaaagaatgatgtctgcctgtccctgggccctgtgaagatctctgtggccactcgcactttgggaattttgctgcataatttcgaaaaaaactagtgcatgttgtcagcttcattcctagtatgtctaagccatgaactcaggtgggaaaagggggagggggatgatactctggtgttctaactggctaagcttcctcttgggaagaattaaaaataaacaggcaaaggaaaggaaggaaccacaga

SEQ ID NO: 465705 - DNA, 1320 bp, Homo sapiens
aggaaaagctaaggatgtggaaggcattgaaattcaaacatgggaagtcaagaagaggaaactcggacaaatgccactggaccgtctgttatctcttgacgtcttttccagttgtcgtagaacctctccaaggtactaagaaagtagaaacatccacactttggatggttaactcaacattgacattgatttttgagacattgacattaacattgatttttaggcaaaataatggaaactaccaggcccctagtgccacagactcttctcacaaccctgggtttgagtacttcctacaaaccaaatattgtatagtagtcctggaacatggcctatctataatcaagaaaaccaggtgttacaaaggtctaatttccgatacattgaatacatctgggtctttagtccaggaaagaatcacctccaagattaacttcctcttccttccacagccccttgactgggcaaacttcaaacaagtgactgagctcccttagctgccactgattggaccaggatggacaacaaatgtaggaggagttcatctggatctagcctgagccagtcagatatcccctttgaatccatgcctatagaaatacaaaaaaatggaagccagaggatgatggatccttgaagtaataagtcagctctgtggaagtttgagtgactcattgcagagaggaattgatgaagtcaacagctgctggaaaaacttctttttccttaatagctgtatcaacatgtggttgctattattcaaagtggatgaaataattctgcaagccagtgggaacaggaagcttcatgaagaggagaaaggcttagggctcagaaaccgcacagagcaggaggatagatgaatgtaaggaacagagctttgaggacagacacctctggattagacaatagctccaaaacttattaatgatggtgaatgggtgactttctaaaaccctttaaaccttatttgtaaaatgggaccatcaatatctattttgaaatcttgtataaatttgcaataatgtctgtaaagtatctgacaggagctcagaaatgacacaattctttaaatccactcacacccaacttttaaacaaaaagtagcagtatatcctacacacgatttttaaattttactatttaagttaacatcatgctatgaacatatttccatgtcattaaatattctattccatccaatatttaaaagctaatagaagtctgttaaatgcatatgccataatttatttaaccaattcggttgttttaatatttatgttgtttccaatatattatgctattgacaataaaatgatg

SEQ ID NO: 465706 - DNA, 1358 bp, Homo sapiens
  misc_feature (1358)..(1358): n is a, c, g, or t
aggaaaagctaaggatgtggaaggcattgaaattcaaacatgggaagtcaagaagaggaaactcggacaaatgccactggaccgtctgttatctcttgacgtcttttccagttgtcgtagaacctctccaaggtactaagaaagtagaaacatccacactttggatggttaactcaacattgacattgatttttgagacattgacattaacattgatttttaggcaaaataatggaaactaccaggcccctagtgccacagactcttctcacaaccctgggtttgagtacttcctacaaaccaaatattgtatagtagtcctggaacatggcctatctataatcaagaaaaccaggtgttacaaaggtctaatttccgatacattgaatacatctgggtctttagtccaggaaagaatcacctccaagattaacttcctcttccttccacagccccttgactgggcaaacttcaaacaagtgactgagctcccttagctgccactgattggaccaggatggacaacaaatgtaggaggagttcatctggatctagcctgagccagtcagatatcccctttgaatccatgcctatagaaatacaaaaaaatggaagccagaggatgatggatccttgaagtaataagtcagctctgtggaagtttgagtgactcattgcagagaggaattgatgaagtcaacagctgctggaaaaacttctttttccttaatagctgtatcaacatgtggttgctattattcaaagtggatgaaataattctgcaagccagtgggaacaggaagcttcatgaagaggagaaaggcttagggctcagaaaccgcacagagcaggaggatagatgaatgtaaggaacagagctttgaggacagacacctctggattagacaatagctccaaaacttattaatgatggtgaatgggtgactttctaaaaccctttaaaccttatttgtaaaatgggaccatcaatatctattttgaaatcttgtataaatttgcaataatgtctgtaaagtatctgacaggagctcagaaatgacacaattctttaaatccactcacacccaacttttaaacaaaaagtagcagtatatcctacacacgatttttaaattttactatttaagttaacatcatgctatgaacatatttccatgtcattaaatattctattccatccaatatttaaaagctaatagaagtctgttaaatgcatatgccataatttatttaaccaattcggttgttttaatatttatgttgtttccaatatattatgctattgacaataaaatgatggcctcgttggcctcagcggtggagctctgccgccggan

SEQ ID NO: 465707 - DNA, 1850 bp, Homo sapiens
ccactgcacccagccattgtgacaacttagtgatttttcccttagtggctctgacacaagaagcagacaggacaggatggggtggaggctcatggtcacagtttgagttttttctccctttaaagtattttccattcctgaggccagtgggatgaaggaagggaaacaaatcacacttaatcctcagatagtggttaattctcataattaaccaggtgtatttcaatttggctttttcgagatgggggggttgacaagcatttcagtttttaaatttttttatgatgaaaaataaaatctatgcaaaagtatgtagtacaatggacatccataaactcagctactgcgattcaataatggttgtatttgtcatatttgctttgtgtgtccatacatatatttaaccatttaaaagtaaattacggacaccgtatcacccccaagtacttcaacatatatttctaaaaaaaaaaaatgatgctgcctgcataagtaaatatgattggcacacctaacaaaattaatttcctgtatcatctaatacatatatatatgttcccaattgtctggaatgtaccttttagctgttttttcccaaaaccatgatcgtgcatcatatatggctgttctatctctgaaatcttttgatgttggaaacaggagccccctgtctcccttccctcgcagcttttcctgaacacactgctgtttgaggtgttcaactcactcctccatccttagcactgcctacaaacaagaaattggatctaaaggctcggttaatccaagctgctgcttcctttcggggcagctcctgggcccctgtgcacagcagggccacatagtgtctgacatccaccattagtggtaacattaggctcaggtggtaacaactggatctttaacctggctccccttattccttaagcatctctcagttgtgccctctctacgcttctcgagggctgtgtcctggcacctcttctgcaagcagagagccagggatgtggcccgccacctgggacaggtacctgctgtactccctctcagatccagaaaagaggtcatagcagtgaaaatgcaggtgagaccatttgattccaccccccaacccgcctgcaaatgtaagcagctttgtgggaggaactagtaaaaaaatttgcatgggaattggaaacatcctaaccaccttgagatcagacgacactgctctgtttccatgctacagggatcctgttaagtgtgacctgtgtcacagaccatcgccttcccctcggtagatgctgaattgaggaggaaggagaggagagcttgaatgaaggctgcattagtgcacgtggctcacataacagccaagatgctacagagccccttgctttcctcactaaggggtagcatgattgtgtgacctttggttataaagctgtgtgaaactcaagactttaaaacgtgctattaagacagaaggatatggtaagaatttttattctgtaagaatcttcaaagctcagcatgaagatacacatctttcccatgggaatccaggctagagaaatgcaagaaggcggttccctctagagtctcctttcctgggagatgcagctccagatgggtgggtttctgggcaggaggggagaggagggtaggtgtttattcaactgtttatttgggatcatgttatgcgtcttcaaaaagcgatataagagaaaatattggaaagatatttcaaaataagaattaccttgaagtaattcccataattaatgggtaacatttttgtgtatgtattttggctttttattgtaaaaataatgtattttcattgtagaaagttttttttaaaaagtaac

SEQ ID NO: 465708 - DNA, 3878 bp, Homo sapiens
tgggtgagtgtggactgcagtgtcgcctactccacccttgctggggagcatggatgttactggtgcccactttgcccccgccttcccccctgcccccggtcttgcctggtgccctcagagcctgagcctctcacccacacctgccatgtaattccggtcctcctctggctgtctcacagaggtcagcggaacggttccgtggagccgccctcccttaagcccagatgctcacaccgagcttcctgattgtccttcttgtcatggctgtgttcaagatgttctttctgtggggcgtctcttccttgctgggctgacagccctgggacagcggggacgccacaccctggggcacaccgcctagggtcccttgtgtggtggggggccaagagagactgctatggaaggtcaccgcaagggtttatactgctccatgcctgcagtgcttctggctctgttgcgggagcacctgaccccagtagccacagccaagaaggttttacttttaaatggcatcggcaggtgggtaagagttgatgatgctgctggcagcgcactggtgttggcggcctctgataaggcaaagccaccttttgctgctgtgttgccgcaagaacacgggtcatctggtgatgcggacacgttcccgttggagctggagcgtgtccccctcgctgctgtgaagaagcacagaggccgtggcctgtgccagcaacacgagtgcagcctgggcgactccctactctgggcctctggtgatctgagctgtgctctgcgggatccacttgtgggcccggcctcagcctggcctgactgcagcatgttctattaagtattcaaaacacgatcagcttgaaggcacatcctccccaacccttgcctgctgctgaggtcggggtctggggtgctcttggtggaggagatgcagctttcaggcctgcatcccagctctgcatgcagcccctgccacctcccacccaagtgccaggaagccactttgtctccctccattctacatgaaagcaccttcccaaagcttctctagtgtttcagggtcttggcccagggtggtgcttccactgggacatggtccccagggtttgtagggcccaggtttgggtcccgtgccggctgccacccagccccagataccacggctgcttcctgtgcagccaccgcatgacagcccccctcacaagatgcccacaggagatgcccgtgtgacagctgcactggctccttccatggctgagcactgggcccagggagcagaaggcactggaagcagaagggaggagccctgccctggcagcatgtgccagtggggttctgaaatgccctcccgtttacatgagaaaagtcggggggtgtggttggtgtgggccttctgaacttcagttcttggatttctcatttttgtaacgcgagtgctatctatgctataacattcttaatactctttaaaattgattcactttaaagaattgcttgctgaggaagctggtgggtgaggacagggttgcggatggtgggaggccctgtgaggaggggcgaggggcttcagggctggaactgccgaacagccagtggaggggccaaacctggggagcgtggggcaactcgtgtgggaggtgttctcgggcaggctcacctgcagcgtctttaagcatgcgctttcatagaatcctcttgcagatcctggggcacctgtgccgccaagagtcctgctcacctggctggctccttggtgccctgacccatggctcttctcacctgtgtgccacccccaagaggcttcttctttcttctgaaacaggccctcatctgtgaaccactgtccattgtggtcccctcctgttcattttgttcattttctgctcttctcttgcttgtttctcccttgacgccataaagtcaatttctcggtctaaatcctggttctcaaccctagagaggatcaatgtccccatatcaacaggaagtagagccagtgacatttctgcctcacccagagtgaggaccaggttggttgtgtgaggtgaagcagagctcttgcggggggctagtgtcatacccctaaccccgccttccattaaggccaaagctgggccctgcggggctttgtcccatggccagacttttttctccctttaaagtattttccattcctgaggccagtgggatgaaggaagggaaacaaatcacacttaatcctcagatagtggttaattctcataattaaccaggtgtatttcaatttggctttttcgagatgggggggttgacaagcatttcagtttttaaatttttttatgatgaaaaataaaatctatgcaaaagtatgtagtacaatggacatccataaactcagctactgcgattcaataatggttgtatttgtcatatttgctttgtgtgtccatacatatatttaaccatttaaaagtaaattacggacaccgtatcacccccaagtacttcaacatatatttctaaaaaaaaaaaatgatgctgcctgcataagtaaatatgattggcacacctaacaaaattaatttcctgtatcatctaatacatatatatatgttcccaattgtctggaatgtaccttttagctgttttttcccaaaaccatgatcgtgcatcatatatggctgttctatctctgaaatcttttgatgttggaaacaggagccccctgtctcccttccctcgcagcttttcctgaacacactgctgtttgaggtgttcaactcactcctccatccttagcactgcctacaaacaagaaattggatctaaaggctcggttaatccaagctgctgcttcctttcggggcagctcctgggcccctgtgcacagcagggccacatagtgtctgacatccaccattagtggtaacattaggctcaggtggtaacaactggatctttaacctggctccccttattccttaagcatctctcagttgtgccctctctacgcttctcgagggctgtgtcctggcacctcttctgcaagcagagagccagggatgtggcccgccacctgggacaggtacctgctgtactccctctcagatccagaaaagaggtcatagcagtgaaaatgcaggtgagaccatttgattccaccccccaacccgcctgcaaatgtaagcagctttgtgggaggaactagtaaaaaaatttgcatgggaattggaaacatcctaaccaccttgagatcagacgacactgctctgtttccatgctacagggatcctgttaagtgtgacctgtgtcacagaccatcgccttcccctcggtagatgctgaattgaggaggaaggagaggagagcttgaatgaaggctgcattagtgcacgtggctcacataacagccaagatgctacagagccccttgctttcctcactaaggggtagcatgattgtgtgacctttggttataaagctgtgtgaaactcaagactttaaaacgtgctattaagacagaaggatatggtaagaatttttattctgtaagaatcttcaaagctcagcatgaagatacacatctttcccatgggaatccaggctagagaaatgcaagaaggcggttccctctagagtctcctttcctgggagatgcagctccagatgggtgggtttctgggcaggaggggagaggagggtaggtgtttattcaactgtttatttgggatcatgttatgcgtcttcaaaaagcgatataagagaaaatattggaaagatatttcaaaataagaattaccttgaagtaattcccataattaatgggtaacatttttgtgtatgtattttggctttttattgtaaaaataatgtattttcattgtagaaagttttttttaaaaagtaac

SEQ ID NO: 465709 - DNA, 838 bp, Homo sapiens
tgcttttatgactaagagactgctggtaagtaagttcccccggatcctgtgcaggtccagagatgccatctagaatccagggcctagagtcagaaaccttaggaatctatgtggtcctctattctactgcagctaagctggcacccaagccacaagatgaagttcttctcactctttccctttccacaagcaggggagtctcttctctcctgtggccaccactgccccaggcccacagtataggaagagccagcaggaaactgggccgtttggcaaaacccactgtgaccatcagtacagatggagatgtcatcacaataaaaaccaaaagcatctttaaaaataatgagatctcctttaagctgggagaagagtttgaggaaatcacgccaggtggccacaaaacaaagagtaaagtaaccttagataaggagtccctgattcaagttcaggactgggatggcaaagaaaccaccataacgagaaagctggtggatgggaaaatggtggtggaaagtactgtgaacagtgttatctgtacacgaacatacgagaaagtatcatcaaactcagtctcaaactcttaaggctttctcaagctgtcatccaaactactgaggttgtttaaataaaactccaaagtaaaataaaaaaaaaaaaaaaaaagatttgcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccg

SEQ ID NO: 465710 - DNA, 413 bp, Homo sapiens
ctaatttttgtatttttagtagagacggggtttcaccgtgttggccaggctggtcttgaactcctgacctcaggtgatgtgcccaccttggccttccaaagtgctgggattacaggtgtgagccaccgcgcccggcctctctttcaatatttttaaggaatgtatgtgtggatagtacttagtttgcacttttctaaatgttaatttcactaactatactgaaatacctcatatttcttttgtcttgtaggaaagtactgtgaacagtgttatctgtacacgaacatacgagaaagtatcatcaaactcagtctcaaactcttaaggctttctcaagctgtcatccaaactactgaggttgtttaaataaaactccaaagtaaaatattacgactattaatatgagagagcct

SEQ ID NO: 465711 - DNA, 811 bp, Homo sapiens
tgcttttatgactaagagactgctggtaagtaagttcccccggatcctgtgcaggtccagagatgccatctagaatccagggcctagagtcagaaaccttaggaatctatgtggtcctctattctactgcagctaagctggcacccaagccacaagatgaagttcttctcactctttccctttccacaagcaggggagtctcttctctcctgtggccaccactgccccaggcccacagtataggaagagccagcaggaaactgggccgtttggcaaaacccactgtgaccatcagtacagatggagatgtcatcacaataaaaaccaaaagcatctttaaaaataatgagatctcctttaagctgggagaagagtttgaggaaatcacgccaggtggccacaaaacaaaggtgaggcctacgacagtctttcagacacatttcaaaagaatgttagtcagatatcatcctcgagtaaagtaaccttagataaggagtccctgattcaagttcaggactgggatggcaaagaaaccaccataacgagaaagctggtggatgggaaaatggtggtggaaagtactgtgaacagtgttatctgtacacgaacatacgagaaagtatcatcaaactcagtctcaaactcttaaggctttctcaagctgtcatccaaactactgaggttgtttaaataaaactccaaagtaaaatattacgactattaatatgagagagcctttctttgcacaagcatcaataattttgcttgccaaattgcacatgcctgtatcatgtagtactttggcattcgc

SEQ ID NO: 465712 - DNA, 1218 bp, Homo sapiens
ttccgccaaagtgggagcacaggcagaggaggcaccaagagcgaatgagggctgtgagggctgccagcacactgtcacctctcataaggagtgattaatctgagcttctccagaaagtcctttcctgggagactatcggggtgcaacctggctggggcggggaggaggtgcagggcctggccagagcgggcctggccacgggcaagggacagcgacttcctgggccaggacaggtgagagcggcgcaggcccgagcccggcgtggcggcggtgtgcgggagaggccagcagagggcgccagagagccaggagcggcccgccgaagagcccgcgccgcccggatgcccagctccgcgccgcgcggacccaacgagcccgcgctcagactccccagctccgccgagaggacgctcgcgctgggtccttcttcttccccaagtgcaggcagagcccccggagtcatggccagcccttccggcagctccgaagccactggcaagccctgaggtagggatggctggcccaggagggaggaggacgacgtccctcccgaagagaagaggctgcggctgttgctggaggggggaagcgcacagcccgaggacggggaggacgcgccgcggccgggcagggaggagaccggcacccagacaggtggcgacggcaaaggatgcaggcagagcccctggagccatggccagcccttccggcagctccgaagccactggcaagccccgaggcagggatggccggcccaggagggaggaggacgacgtccctcctgaagagaagaggctgcggctgttgctggaggggggaagcgcacagcccgaggactgcgaggacggggaggacgcgctgcggccgggcaaggaggacaccggcacccagacaggtggcgacggcagaggagcgtgatggcatacacctgtaatcccagctacttgggaagctgaggtaggagaatcatttgaatctgggagacagaggttgcagtcagccgagatcgcaccactgtacttcagccagcctgggtgacagagagagactctgtttcaaaaataaataaataaataaaatagaattctgaattttatttttaataattatttttgtaaagagaatgtcttgttttttggagttgttgaatttattgaattggcaaaaattatgtacaaaagggtatacaacatgatgtgattgaagtatgtgtacatt

SEQ ID NO: 465713 - DNA, 1476 bp, Homo sapiens
ctgacaggcaagtttcaagacagtggctaagcccaggtcctgaagagaggaggaccgtgcaggcggccccaacagaggacggggacagctctctccttctgtaagtgaggcagcctcatccttccctggatcctcagcatctcttaaccagcagtggcagaggttgaattagaatggcaccagcttcggataaaaatccagatctcgcttttcaaaatgtgtctagagctggtggctgtaaggaaccagtcaagcctcagctgtgactctaatcctgccaagtccacctgagagccgactcattcatccaaagagagaacggtttggatggagctcaaggtgcctggctcgctggcatagcccagacaacctcttaaaggccgggccacagagctagaaggtctgtcactactcagttggggaaatcgtctgagaagttcaagtccactgcctcgcaactcaaatgagtcagcctcaccaaccaagaatcgcgttcataaacagactcagagcctgcgtgccgtggggtttccccgtctgcaactctctcacctggccctcctgcagggcccggcggggactggggagggtcagtgctccctggggcggggactgggtctgtttccaggctcagtgcctctgagtcatacagatgccaggtggtcctgctgcttaccctcgctgaacctcaggcttctcgtgtaaacagggcgcttttgaggaattattattaacatctccctgtgagtcaaagcacctactgagataatgtatgtgatgcttgtaataaatgcagctacatgccaggcactctgagatgctgcctttgtggttattatttttagctcagccgtatgcgtgccggaatgtgttcctgttggctgtgcgtctaccatggaaagaaagttattgagagtctattatacgccagacactgtactctagggacttgggatgtgaatattagatacacaagtgcctttgaggagcttatagtccatcatggggtgacaaaaaaagtaacagataattataccatatgtttgaagcagtgtcatggaacagagaaaaacagtaagggatttggagcccagcaggaaacaggtggctgtacacagttggccgtcaggaccattctccactggaaagaatactaccgattgggtaatttatacaggattgaagtttatttaactcatggttctggagtctgggaagtccaagagcatggtgttacctgtgcccccatacggtaggtgacattatccttgtgtgatagcttaggacacagaggagacttggctataggccaggcaaggagtcaagccaaggtctggggacccccaggtccctgcattcttggatattttgcatctttggagaaagtcattggttggccctggcactcttgaactcaggctccaaggctcagctctggggttaccttactggtgtatgtactggcttttctctaga

SEQ ID NO: 465714 - DNA, 2230 bp, Homo sapiens
gagaattttcgcctcatgacagtggagattttgggtttgggctttggttgcaatcaccgaagcagtgcactgattcacctttgccaatctgctgggggtgagaggagagcacagcgaagacagacagagacaggacatcagaatgaagtaaggaagcagagaggaccaaaggtggaggatgaagacaatctcctggctggctgtgtccattcactcagcgagcattcacggaggggctgctgggtgccaggaccatgcctgatcccaggagatgagagtggacaagacagcaaaggccctgcctctggcactcatcacctaaatggacaaccagcaagtagtccaacaaataattaccaactgcaacacgccacgaaggacaaaggcaaggagccatggtggagcatgagggagtgtggaagagcactatgaaccaaagctacaaatgctttatgaccattaactcatttaactgtcacaatacctgtttgactttatgagctatcatataaataaaaagtataacatggtaaaacattacccacgttgtcctgttagaaagggaagaggggacttgaaaataggagaaggaaagaagaaacaggaatacttgttatcctagctcaggttagagagatgtgaccgaccaaacctacgagagttcgaacttcgcttcccgttgactctccacgttgaaggaaggagagggggatgtcaatgtggtaggtgggggagccagcagggtacctgccttgctgaagcccctgggctcaagcaggaagttattcccagctggatatggaagcacaaaggcacccatgtcgccctagacctctgaagctcagctgcaagggagccacactctgagctcccattctctgctcctgaaaagaaaggcaatcgctcctggcctcccggcagctgtgggcaggccaccgtgggatctatgaagccccagcctggcgacttggcactaacagagtcacggggaaacatgtaacttccatgttacaaatggggatcactattcaagactgttcaggcaagaagtgattccagcctgggcctgcctctggagcacaaggttttccctactctacctcctcgcttctccatgtagcccagcacacagaggtttgctgcttcatgtaagaaaagcgtcctgcaggaagcataacaggcattttgcagcaagtgttttgcaaagcacacatcttcacagttctagcatctgtggtgatttatgcagtggcaaatcgaacagaaatagctacagcaataaaaatacagttaaagaagtctctgtactttaaaggctgaacttcaagcaactgcagacttagggcctgatgattctctgtaattagtacatcagttttgatataaggagggatggatcagcataagacagaggtggaaagaaaccgaaggcagcacaaagccacataaaggacagagcacagcaccagggctagatgaaagttacagacactgtgccagacatttgcagctgagaccctctacctggtgaggttttaggtggccaagcctcattaaaaagttaaatctgtatatcaatctaagctaattgctcagtaagctgcgtagttcattttatagtatgggcccacttattcccagtggatcttgtggtttataaaaacctgagaaaaagagctacatatgaacaccaacagggtgaacctattaaacagtatttgtgggccctgaaattagccctgccttctcctgcccaccacccagactccagcccagtgataagcaacagaaatctaccatgttcatccagtagccacacttccacacctgcctcttcaccttttctccaagggcaagtaggaggaggaacaaaagggaaaaggatgcagtggaaagaccagtctcactgaagtctcgcaagttaaccttgtaagatcaatccagctaggtgctcagggaccattttctatttacttcctggttctgtttttagaagcaaaaggccatggagctactttatcctagagtggctttgctttttagaggacagtggaggaaaacaaaacaaaactccatacttagatctcctagaatattttaatttgcagccatgagatctcttatcataaattgaagaagggacagaaaaaaagggtacttactccactcaaacctaatttccatactcaactctccacttgtctattacaagagtgcttgaagcctggat

SEQ ID NO: 465715 - DNA, 2336 bp, Homo sapiens
aaaaaaacctatctagggaggagccaagatggccgcataggaacagctccagtccacagctcccagcgtgagcgacgcagaagacgggtgatttctgcatttccatctgaggtaccgggttcttctcactagggagttccagacagtgggcgcagcaggcttttcttcttggagctgaaacaggcgcactggcgagggttgtgaggaaaggtttgcagccccctgccttggtctgctatagccagtgacacgatcaataccagggtgagcagcagaggaagctcagggaagattatgaagatgagaattcattacctatcaaagaaaatgcgtaaactctagaagtattgcttgctcctttgccacaaagtgtacattcaagagtaaattgtttaaagccaaagggccttgcgccacgtccttagcctcagctttctacttgctaaaatggaaataacaacagtacctaccttacagacctggcgtgaggattaaattataccagcaaagtgcctggcacctagaatttgcctgagttctgatcaatgctaaaaacaccatttaacagtgccctttcctgcctgggaagcccacaaagatttcgcttttcacttattactcatcaaactgactctggttcacagtggaaaagagaagaaaagctgatggagaaatggcagtgaagaaggagaacaaaatgtcagagcaatacttttgagcgacttatcctctgttctgcaatatttgcaaaagtcagtctatagacgtgaagccaacagggaccctcaggcctgtgcatcaggatggtgggctgcctaagtcctctggggacagcagtgccagaaggagtattggacacagtgacccgactgtatgagatgagaaaaaacaaaaacaggaggtccgcagtactgatgaactaatctgtcactcacaagctcaggtctgcaaaaaaaagaaacgaagcactaaacatggccataagagatggaaatgcaagtcttcatttctaaatgataatcaaaccaacgatcagaaactgattaactgtgtaattgaattgaattgaaaatcatcccatgaataacaatccatcctaccttcaaggggttaggaagctaactacaggtaattgctatcagaaatctgatttgatttccaaaaattgtgtgaatgaaccaagtttcttcatcttgatatactaggcagggagtttgttcttccaagtactagactgcttaattgcttgcttgggggaggagaaatcctaggggaaaggcatatatgagcaatttctactctgtgaagccagcgctgtgtcctgagctggatcatggccagaaacagaaaagtctactcttccctacagtggaagcaactgtggatatttcatcctaggagtgaatgaaaaaacctaaagctcatacttcatgggaatctttcaatattctgactgaaaactggttatttgctcctccaacccaaagccatctaggaacagcactcagaacaggaaaaaaaaaagacaaaaataataattattccaaaacgtatttgagcagaaacaaacacaaacatttgcattattaaatgggcttgttcacacctgctgagtagatataagacgatatttaagacaagagctaaaaaataaaccatccctttctggttttgagtgacagcagagcaataaaaattattttcacattcttttccctattgttagaagtaatcatttgagtaaatacacttatctgtgctgtaactattgaaatgaatccacttcaaatatgtataccacctttcttttttatatttctagatatggtttcaatatagactttctgacttttatggtatacatataggacaatattctattcttctttccttttaaatacttactgtttcaatttcaaataaaaaatcagcattctagtttgtacattttagcacagaaatgtttacaaccttcagcacaattgcttttgtaatttactgacttggcattttgaggcgtttttaacaaattatgagaaataacaccttcagaaagcatgtgactactttgatgcaactatttacaatgtattcataagaagtcattaacctgtagagttcttagacatgtggaacctttaacaattatactaaagagtacatacaaaatacagagctatgtaataataactaattttaaatcctgacaaattagaagttaagcctactatctgtaaaaatatgtcctgattcatttttttaagtatatacctgagcctttaaaaagtatatgcctttacaattgatttccaataaacaatactgaataacatact

SEQ ID NO: 465716 - DNA, 806 bp, Homo sapiens
  misc_feature (768)..(768): n is a, c, g, or t
  misc_feature (774)..(774): n is a, c, g, or t
aaaaaaacctatctagggaggagccaagatggccgcataggaacagctccagtccacagctcccagcgtgagcgacgcagaagacgggtgatttctgcatttccatctgaggtaccgggttcttctcactagggagttccagacagtgggcgcagcaggcttttcttcttggagctgaaacaggcgcactggcgagggttgtgaggaaaggtttgcagccccctgccttggtctgctatagccagtgacacgatcaataccagggtgagcagcagaggaagctcagggaagattatgaagatgagaattcattacctatcaaagaaaatgcgtaaactctagaagtattgcttgctcctttgccacaaagtgtacattcaagagtaaattgtttaaagccaaagggccttgcgccacgtccttagcctcagctttctacttgctaaaatggaaataacaacagtacctaccttacagacctggcgtgaggattaaattataccagcaaagtgcctggcacctagaatttgcctgagttctgatcaatgctaaaaacaccatttaacagtgccctttcctgcctgggaagcccacaaagatttcgcttttcacttattactcatcaaactgactctggttcacagtggaaaagagaagaaaagctgatggagaaatggcagtgaagaaggagaacaaaatgtcagagcaatacttttgagcgacttaccctccggtcctgcaaatatttgcaaaaagtcaagtcctatnagaccntggaaggcccaaccaggggaacccctcaaggg

SEQ ID NO: 465717 - DNA, 539 bp, Homo sapiens
cctagaggcaaagattgcagtgaactgagattgtgccactgcactccagcttgggcaacagagtgagaccctgtctcgaaaacaacaacaacaacaacaacaacaaaacttgtaaatcactaacctcaaggcaaaatcaaccttatattaacaaactggtttcaaaatctctggattttgcctaaggaagagcagagtaatagtaatcactttgtttctcctagaattcattacctatcaaagaaaatgcgtaaactctagaagtattgcttgctcctttgccacaaagtgtacattcaagagtaaattgtttaaagccaaaggtaagactaaacaacttatttaatatcatcctgtctgttatttctaggtcttctttgataacatgtcaaggagttacatttgacatagccctgttatttttaccacaggttagttttaaaccccattgtggcttataatcaacattaccatcaacatcaccaacaaatcacatcaccatgactatcaccaccacatcatcactatcaccaacatca

SEQ ID NO: 465718 - DNA, 1432 bp, Homo sapiens
aaaaaaacctatctagggaggagccaagatggccgcataggaacagctccagtccacagctcccagcgtgagcgacgcagaagacgggtgatttctgcatttccatctgaggtaccgggttcttctcactagggagttccagacagtgggcgcagcaggcttttcttcttggagctgaaacaggcgcactggcgagggttgtgaggaaaggtttgcagccccctgccttggtctgctatagccagtgacacgatcaataccagggtgagcagcagaggaagctcagggaagattatgaagatgagaattcattacctatcaaagaaaatgcgtaaactctagaagtattgcttgctcctttgccacaaagtgtacattcaagagtaaattgtttaaagccaaagggccttgcgccacgtccttagcctcagctttctacttgctaaaatggaaataacaacagtacctaccttacagacctggcgtgaggattaaattataccagcaaagtgcctggcacctagaatttgcctgagttctgatcaatgctaaaaacaccatttaacagtgccctttcctgcctgggaagcccacaaagatttcgcttttcacttattactcatcaaactgactctggttcacagtggaaaagagaagaaaagctgatggagaaatggcagtgaagaaggagaacaaaatgtcagagcaatacttttgagcgactatatccttttcattaaaggtgtcaacacgtttatttgcatctttgaccctaggactagggaagtgctggaaattatgtgggtactttttcccatgggaaaaatgtacctcctggtgaagaaacatccttcactgacctctgaaacaaatattatagattttacacgcaggaaacttattacatgcaaactttcttttgtaagcatttgtattctaaaagttgcagccacctctctgcatatgttagagtctatagacgtgaagccaacagggaccctcaggcctgtgcatcaggatggtgggctgcctaagtcctctggggacagcagtgccagaaggagtattggacacagtgacccgactatacaaggaggaggcactaaatggagctgtttattaaagctgctgtgctggattgcattaggaagcgcgagcagaccacctggacctttcaagattgtgacagtgtttaatttgcagcctgcccttctgcagcagccaagactactactacatttaccgggctcaatcacacattatctgggttagaagtcaaggcacatgtatttatatatttatatttcccatatggagaaagggagagagggagagaaagagagaaggagagagcacagtcaaaataaaaatattgaacagcattagaaaaatattaactactacctaggaaaccacacttgattctcttctc

SEQ ID NO: 465719 - DNA, 1142 bp, Homo sapiens
tgatgaatcatggatactttcactgatcctttcaagtgcccctgcccctacctacgccttttagagatacccataatgcttacattggtttgctttatggtatcgtgtttgaggtgtgggcatgcacatggtggtgccagagtctggggcatgagtctggggcatgagcacacatacggtgtggtactgggatccaagaaggccatgtgcagagcttcactggtaccaatgtttaaggtgtggacatgctcatggcagcaatcacaccagtttctgtggtatagcacatatagggagcaaggaagggatatagtggtagctccttctggactggagagcggcacaggaacatggactctgggcagctctgtcaaccagagtcagcattggcaaagactacagaggctcaatggcaaaaaccactgggatcattgtgctctgtttaccccactggtagaagtcagaaccaagaggatccctcttggtgctgactgtgccaggctgggaaatggggtggcacagtctggtgacagtggactctggacagagataaatgagaggtcaagctacccttcatttttccagaggattatttcacccacagataaggcacgaagaaggaagtaatagtcaagaccagcctgtgagaaaacaacaaaaaaaggataactaacaaaagccccattctccagctcttgccccggccagcgcttcagcacgccttgtctcacccctgaaggaagagcttcatccctttccagtgaagcctgcttgccctgtatgatgcagggtcaaagtatgaggtgctcctcaactacccaatccaccggtgcatcatgagtcctcaacatccatgtaaaccacttttcctataaagagcagatgcatgagaacaaacccatttgaaaggaacactttggcttcatggttctcatagaattctaatgaggaatgggtcattttctggcactaggtaagtgattctgacataacctggacctgtataatcatatgattagagcatttagggagaaaatgtatcacagaaaatgatagtaataataatttatcagtaataaagtaaatatgcatagagaactttagaagtgttttttgtcgatgaattctttttcagtcttacc

SEQ ID NO: 465720 - DNA, 1730 bp, Homo sapiens
ttctgctctcctcacccttcaattatgatatagcccttcagttcatggtttaaaaaagcaaagggagggcggttgcgggagggagcggggcaggcgctgtgggccaggcccctcctctggctcctgcaccaccgcctcttttcgggctccgccggctcccgccgtccctgcaatgccgctctgtgcccgccgtcctgagagcccgcgcggcactggcgccagccttggcggcgcgcgcggggccgtggtcgttgctccctgactggccgcggcggcctccaggaagcggaaaagcaaggggcggtcgagctgggccgccgcgccccactgctcgccgcgctgctctttgacctcgcagggtgtgaagaagatgcgcagctccacgctgcaggacccgcgccgccgggacccccaggacgacgtgtacgtggacatcaccgatcgccttcgttttgccattctctacagcagaccaaagagtgcatcaaatgtacattatttcagcatagataatgaactcgaatatgagaacttctccgaagactttggaccactcaatctggcaatggtttacagatattgttgcaagataaataagaaattaaagtccattacaatgttaaggaagaaaattgttcattttactggctctgatcagagaaaacaagcaaatgctgccttccttgttggatgctacatggttatatacttggggagaaccccagaagcagcatatagaatattaatctttggagatacaccctatattcctttcagagatgctgcctatggaagctgcaatttctacattacacttcttgactgttttcatgcagtaaagaaggcaatgcagtatggcttccttaatttcaactcatttaaccttgatgaatatgaacactatgaaaaagcagaaaacggagatttaaattggataataccagaccgatttattgccttctgtggacctcattcaagagccagacttgaaagtggttaccaccaacattctcccgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaaagatttctggatatctgtgaaaatgctgagggtgccattgcagtacattgtaaagctggccttggtcgcacaggcactctgatagcctgctacatcatgaagcattacaggatgacagcagccgagaccattgcgtgggtaaggatctgcagacctggcttggtgatcgggcctcagcagcagtttttggtgatgaagcaaacaagcctctggctggaaggggactattttcgtcagaggttaaaggggcaggagaatggacaacacagagcagccttctccaaacttctctctggtgttgatgacatttccataaatggggtcgagaatcaagaccagcaagaacccaaaccttacagtgatgacgacgaaatcaatggagtgacacaaggtgatagaagtcgggccctgaaaaggcgaagacaatcaaaaacaaacgatattcttctcccatctcccctggctgtgctgacctttacactgtgtagtgttgtcatctggtggattgtttgtgactacattcttcccatcctgctattctgactcaaagatttcagaa

SEQ ID NO: 465721 - DNA, 1514 bp, Homo sapiens
ccgtctgcagaagacgagatcagaagaatctcagacacatgctccaggcaacccaggctcaataacccagcagtgattccaggtcctacacgtgacattacctgcaaggtggctgcctgcagtgccagctcagggcacagccatgtgggtgagctggcagccagtgggctgggctgacaacctgtgccacacacacgctggacagaagctgcctcccctccacatggaggtgggatgagggcatatccttggatgccaccaggattttcttcagaaattggagcctgctgcagtgcccaaaagaaggggcaacaaaggccaccaaaactccacagtaaatggcatggattattttaatatttgaaaaaccttaaagtgactgtggcaaaatacttacttctgatacataaaataaatttcataaagtgtcacatgatttttattgttagtgtcccctcttggtgtaccttcttctaaaataaactggcataaagaactgtttctagggaaattgaatgaattagtgtgttatgtagaattaatatctttatgctagttaaaagttggggaacctctgatgaaaatgatgacttggatttaaaaatagatctctagttcttcttcccagcagatatcctataggagggtcatttatctattgaaagcatacctagtttgtgataagagagcctcttcatctatattttggctacttatgattttatttttataggattccttatcaattattaacacattttcttgataataaatcatctaggcacagatggaatctcctcccactggtgaaggcaaatgcttgtctcagcagaagagcagaaaagtaagagcaagaagcttttccttggatactttatgccacagcaaagccagagagaagccaattacatttgcttcccatgatgctgcaaagcttctggtggtttgctctcaatctttggtattcctggcttgtatctgcagcaattccatctctacctccattgtcatatagccttctccctgcatgtctgtctttcttcttcccacaagacaccagcatactggatttgtggcatgccctcttccagtatgaccttatcttaactaatcaatctccagtggccctattttcaaagatactggaggattgcccaccgaagctaaccagctggggaacaaagggctggaaatccagacaaggaattggcacttctacagatgacagtgatggtggtcatgatgatgatgatggcgatggtgacagttatggtaaggacaaagcaactagtatttatttagcactaactgtggaccaggttctcagtctaggcggtgggaaacgaaagggagctgattctgtattgatagatatgcacatagggactttgtttcaagagaatttgtagggttacaaaattacctaaaattagctaatgaaaacaataatgaattatacttgatgattagcctgatagtctaaatagaataatagtattccagcataatagtct

SEQ ID NO: 465722 - DNA, 2154 bp, Homo sapiens
tctctcctccaggtttcagaaggtttctcccagaatctccctttagggtgggcctctatttgctgacattaagagaatatgaattgggtggcttacagcctttgcctttttatgggaatttccaagtttcccgggttcaccgcattcaacctcgtaaagttgcatgaaataaaatgttcttccagcaggcggcactggaggcttctggaggctctggaagccaccggctccgggaatacacagaagtcctctgagggctacagtcggaaaggagacccgctttctcagttcaagcagcagcagaggccaggggcgggaaaggttcttggccaaggtcagtgtggggacttcacaatccaagtgcaaaatggcttcagtagtgacataaacaatgcccttgtgcagtcccctgtgcagttgtcaaggccacactccccaaagccagagctttgctcagcactcagctggctgcatgtcaaagtcctcaagggctctttttttcaaaacaagtggactgtattttgaacacaaacctgcatatttatcaagtgtttgaaggtgattctgaagcataggcaggtttgggaagtacctgtgtaggttatcagggttgttcgtgtagataagcatagagggcttttagtgctaaataaaataagaccttagatatagtctgaatcctcatattttcttcttttttaattccaggaaagttaggaccatatacttgcaattatacagtatgtagccttttcagattggcttgtttcacttagtaattcacatgtatttaagatccctctttatcttttcatggcttgggactcattttttaaaatagattttattttttagagtgatttgtagatccacagcaaaattgagcagaagctacggagatttcctatggaaaccctgccctcagggatgcatagcctgcctgactatcaaaatccagcacaagagtggtcgttatgttacaatcaatgagcctacatggacacatcactctcacccaaagccataaatttcgctgtaagcactgctttcactgtaccccacaaattttggtgattgattatgctgttgagtttgactatgtccttactgatgttctgtctgctggatctgtccatttatgattgaagaacgtcaaaatcttcaacttatttttgcagtgagatgccctccgccttagactttgcattatctaccactgcataataaagtactccaaaatataatagttggaaatacaagcatttcttatcttacagtttctgtgggaggatgtcctgttagcaacttctttggacacaaggaggaaattaagaagcatcattactgttaatatcattttctttttcagaatgttaacagccttgatattatacaaaggttgataaaaatgtatttcataagtcaattattgcatcataattcaaaaaaatagtagcaaacattgttgtttagaaatcagaaataagtaacgatcactcttggatataacttccccataaactaaagcatatcccactgtgtgatatctgagagttaacaattctccaaaactttcaaatagaagctcaattacagcatggtttttttttaatcactgattattttaactgtattaatcaaagaaagcagcaaatgattttttttaatccattgattcttttagcaggcattcaaataattcagaaaagacgtgtttctaacttttatgttagaattaaagtaagcattttcttaagaatcttcgggtttgggctcgtcagattactagacatatttagatggttcttgtcattatgtcctcataaatacaaattgcaactgtggtaatgagaagcgattccctccttgttagaaaatagcaatatccattagtaaaagtctgaggcttgttgtgactgataaaaaaaaacaaaagaaagcaaaatcataagtgagtaagaagctttttaaactttgggaagcctgaattctcatggggttctctagtgcatatgaagttacgaaccgtaaatttggtagttagtgggttctccagtaagcaaaaagcgtctatttaagtatattcttgctttataaagtttattgttcaaaaatttgctctaagagagagagcatatctctgttctccctaac

SEQ ID NO: 465723 - DNA, 879 bp, Homo sapiens
tccattcacatagcaagcttcatgcaatgtcatccaaaaagatttctaatttctataaagttttggcccttcttcctgtctttgtgaaaaatgcagaccagatgaaaaccactttctacaaggcaaacaataacaacagcttctgtgaattaaacatctactgtgccaggcacttggcaaacatcatctcatttaattctcacaccttctcaagtaggtatggctcactctacgatacagaccatgaaactgaggctcagaaagttgcagccatttcccccacgtgttcacgggatgaagcccaaacctctgtgctttcaagcagccctgtggacgattctgatgtgctgccaggcatgagtactcctgacgatatgatctttgaggacaggcatttgttcttattcatcattgtatcctaataagtaacatatgggcatgcaattaaaaaacgaagtcacatggaagataaataacatgctcaacatcacccagccagaagtggtggagacatggccaacatcacaggggacaactcctgagcctgtgctaggaacagccagtcttcctgaattcatgataaagtaagaggtagaaccgtggccaattgtctttgggagaaagtgggatcaaggacaactccaggattctgcctgagatgggacacactagagcattacttgggaatgtaaataataatatcaaattattgaatgatttccatgggctactctcttcatataccagttctaattctgataagcttgtatcattatcttctttttaaaaggcatgaaaacagaggctcacagagatcatattattttccccaagttgcaatgatggtaaacacagatgacagctggacatcaactaggt

SEQ ID NO: 465724 - DNA, 2766 bp, Homo sapiens
gggtagtgtgcctctgtcctcacgaggggccgccgcgcctctgtcctcacgaggggccgccgcgtctctgtcctcgccgaggggccgccgcgtctctgtcctcgccgaggggccgccgcgtctctgtcctcgccgagggggcgccgcgtctctgtcctcacgaggggccgccgcgtctctgtcctcacgaggggccgccgcgtctctgtcctcgccgaggggccgccgcgtctctgtcctcgccgagggggcgccgcgtctctgtcctcacgaggggccgccgcgtctctgtcctcacgaggggccgccgcgcctctgtcctcgccgaggggccgccgcgtctctgtcctcgccgaggggccgccgcgtctctgtcctcgccgagggggcgccgcgtctctgtcctcgccgagggggcgccgcgtctctgtcctcacgaggggccgccgcgtctctgtcctcacgaggggccgccgcgtctctgtcctcacgaggggccgccgcgtctctgtcctcacgaggggccgccgcgtctctgtcctcgccgggggggcgccgcgtctctgtcctcacgaggggccgccgcgcctctgtcctcacgaggggccgccgcgcctctgtcctcacgaggggccgccgcgtctctgtcctcgccgagggggcgccgcgtctctgtcctcacgaggggccgccgcgcctctgtcctcacgaggggccgccgcgtctctgtcctcgccgagggggcgccgcgtctctgtcctcgccgaggggccgccgcgtctctgtcctcacgaggggccgccgcgtctctgtcctcacgaggggccgccgcgcctctgtcctcacgaggggccgccgcgtctctgtcctcacgaggggccgccgcgtctctgtcctcgccgagggggcgccgcgtctctgtcctcacgaggggccgccgcgtctctgtcctcgccgaggggccgccgcgtctctgtcctcacgaggggccgccgcgtctctgtcctcgccgaggggccgccgcgtctctgtcctcacgaggggccgccgcgtctctgtcctcgccgaggggccgccgcgtctctgtcctcacgaggggccgccgcgtctctgtcctcgccgaggggccgccgcgtctctgtcctcgccgagggggcgccgcgtctctgtcctcacgaggggccgccgcgtctctgtcctcgccgagggggcgccgcgtctctgtcctcacgaggggccgccgcgtctctgtcctcgccgaggggccgccgcgtctctgtcctcacgaggggccgccgcgtctctgtcctcgccgaggggccgccgcgtctctgtcctcacgagggggcgccgcgtctctgtcctcacgaggggccgccgcgtctctgtcctcacgaggggccgccgcgtctctgtcctcgccgaggggccgccacgtctctgtcctcactgaggtgttgagactgccatggtttatccatggtgcttcctgcccaccctctccccagccgcccgtttcaagccatgctgcccctctcagcctgtgagaattggctgtgctacctcttctgagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtatgttttttactgtttttctcttgcatagtgacatccacttaaaagtttattaaaagaaacaaatataatgcttaaatgttaaaacatactttaaaaatattcaatgtaaaataattagttgtaaggcaactaatataagtaaaaaatattcaatgtaaataattagttataaggcaaagatcagagtatttatgtgctttccaccgatgatgtggatgggcatgcgcccctggcgtatccagagaagcagtgtggtggccctggccagctgtgccaaggacaggctggccccgtgtcctccatgcctctaaggtcaggttttggagtgtgttggcatccaggctatttttctaaacaagagataaatccagattggaggttttgatgagctgagctcaccttcataagcagactgagaggtgaaggaaacacagcttgcgcctttaggacaggtttcattttctcttccacatagaacggatgcacgatttctcagcatgcattattgtgcagttgtttgtactgacataagataaggaaaataaacataggtttaatgtca

SEQ ID NO: 465725 - DNA, 1717 bp, Homo sapiens
ccctaatccaataagactggtgtccatataagaagaggaaatttggggatccggcatggtggctcacaccttagaaattctgcccatcctttgtgctgcttttggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaagcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacgcagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtgaaaactttgaaatgtggtctgtaggggac

SEQ ID NO: 465726 - DNA, 440 bp, Homo sapiens
cagtctgaaggattgaatgagagcctggcatacctgcctggagccctgagggcacatagaaggtaccagataaccgttatagcgcctccttttccccttctacttccagaaaccatggtgagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtgaaaactttgaaatgtggtctgtaggggac

SEQ ID NO: 465727 - DNA, 2220 bp, Homo sapiens
ccctaatccaataagactggtgtccatataagaagaggaaatttggggatccggcatggtggctcacaccttagaaattctgcccatcctttgtgctgcttttggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaagcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacgcagggaaccaagcagtcaaagctcaaagccttgcagaggccaaatggtgagagattttagacacgagttttccatgacttcaaagtagcaactagtaaaatggacctgcaagaggcctgccgaggccagctgtgctctcgtgggtggttacgtagccaacatggtccagggtttcttggaacaataaatatcctgtccgtaggtctgtgagctctgggtgttccatcctgacttgatacccctcccaaaggaccctaaaaagcagggaggtgtgcaggatgaacccctcagccccctcactgtagagacagagaaacaagggcatgtagaggcgacaagtttgggtcagcatcccctggggggccaggatccctaagttggccccctctcatgagcatccggccacaccacgggcacagctgggccgaggccccacatgtgtcacatgagaggctggctctgatggcttgtacggctgctgtgttgctgggggagaggcagccacgaccttgtgtttaggtccccactgtggggctttccttctagaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtgaaaactttgaaatgtggtctgtaggggac

SEQ ID NO: 465728 - DNA, 1435 bp, Homo sapiens
  misc_feature (1303)..(1303): n is a, c, g, or t
  misc_feature (1307)..(1307): n is a, c, g, or t
ccctaatccaataagactggtgtccatataagaagaggaaatttggggatccggcatggtggctcacaccttagaaattctgcccatcctttgtgctgcttttggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaagcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccggganttcncggtacatgcaagcttgcatgtaccgggcttgcatgtaccgcttgcatgtaccgggcttgatgtggggaggggtgtttaaggggttggctagggtataattgtctgggtcgcctaggaggtctggtga

SEQ ID NO: 465729 - DNA, 1005 bp, Homo sapiens
  misc_feature (3)..(3): n is a, c, g, or t
  misc_feature (8)..(8): n is a, c, g, or t
  misc_feature (10)..(10): n is a, c, g, or t
  misc_feature (32)..(32): n is a, c, g, or t
  misc_feature (34)..(35): n is a, c, g, or t
  misc_feature (58)..(59): n is a, c, g, or t
  misc_feature (61)..(61): n is a, c, g, or t
ttnttccncnctttaagttatggtgaattctnanntttcggcatctcgtcgctgtcgnnantcagctgcggaagccctgacccgggagttctcggtgctcaagatccggcccctcacgcagggaaccaagcagtcaaagctcaaagccttgcagaggccaaatggtgagagattttagacacgagttttccatgacttcaaagtagcaactagtaaaatggacctgcaagaggcctgccgaggccagctgtgctctcgtgggtggttacgtagccaacatggtccagggtttcttggaacaataaatatcctgtccgtaggtctgtgagctctgggtgttccatcctgacttgatacccctcccaaaggaccctaaaaagcagggaggtgtgcaggatgaacccctcagccccctcactgtagagacagagaaacaagggcatgtagaggcgacaagtttgggtcagcatcccctggggggccaggatccctaagttggccccctctcatgagcatccggccacaccacgggcacagctgggccgaggccccacatgtgtcacatgagaggctggctctgatggcttgtacggctgctgtgttgctgggggagaggcagccacgaccttgtgtttaggtccccactgtggggctttccttctagaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtgaaaactttgaaatgtggtctgtaggggac

SEQ ID NO: 465730 - DNA, 963 bp, Homo sapiens
cagtctgaaggattgaatgagagcctggcatacctgcctggagccctgagggcacatagaaggtaccagataaccgttatagcgcctccttttccccttctacttccagaaaccatggtatggtgagagattttagacacgagttttccatgacttcaaagtagcaactagtaaaatggacctgcaagaggcctgccgaggccagctgtgctctcgtgggtggttacgtagccaacatggtccagggtttcttggaacaataaatatcctgtccgtaggtctgtgagctctgggtgttccatcctgacttgatacccctcccaaaggaccctaaaaagcagggaggtgtgcaggatgaacccctcagccccctcactgtagagacagagaaacaagggcatgtagaggcgacaagtttgggtcagcatcccctggggggccaggatccctaagttggccccctctcatgagcatccggccacaccacgggcacagctgggccgaggccccacatgtgtcacatgagaggctggctctgatggcttgtacggctgctgtgttgctgggggagaggcagccacgaccttgtgtttaggtccccactgtggggctttccttctagaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtgaaaactttgaaatgtggtctgtaggggac

SEQ ID NO: 465731 - DNA, 527 bp, Homo sapiens
agcgctcaagacggaggacctgctggcaacgttttctgagttccagtgagtggtggctggggaggtgctgccttcagagaggagctaagatacttctctgtagctgggggtgcttgcctgccccacacccagtgcctaatgcttcagcaagagagacagaaagtgggtgtgttgcctgggctctgtattcctgggcagttctccctgccggccgtccctcgggaaagagagcactgatttgttggttgtagacacaccctgcaggccctagacctgggctgcccccctgcatggccacacgcctgccaggatgccatgcgccctccctcagtctcaagggacatggcagcctcctcttctcctcttgcctgcctcccagcggctgctcagtgtgtctccagcaggctacgggccagctccatgtgggaactgtttctagggtgcactgagcagcctgctggggcagagtggaggtcggaatggtggccagaggctgtattgagagacacgacttccctcctcctcag

SEQ ID NO: 465732 - DNA, 531 bp, Homo sapiens
gtccctgtgcgggcctgtggggctctgggggatgaggcaagcaggcggcagtcgtctcttgcccatccagggcggtgtcggagcagccctgccctgagctttgaataggtgcacaacacggctgcaggggttcggggtggtgggtgtgccgcggggtcctgaggaggagggagtggctccacgcctgctttctttccacagctgcggaagccctgacccgggagttctcggtgctcaagatccggcccctcacgcagggaaccaagcagtcaaagctcaaagccttgcagaggccaagtaaggaaagcgcatgtccctgaatagggaggctgtgtgtgtgtgtgtgcgtgcgagcatgtgtgtgtgtgcgtgtgtgtgtgtctggtttgggcagggtcttcccctctgttaattcttcccgcttgacttctctgctcttagggagccctgggctgcagtagccagtggggctgtgttccccctccctagcaggcctagggggggtctggggcaggggtctcccttggggag

SEQ ID NO: 465733 - DNA, 537 bp, Homo sapiens
  misc_feature (405)..(405): n is a, c, g, or t
  misc_feature (409)..(409): n is a, c, g, or t
ctgtgttatagaggatccctcgaagatggcggttgtaagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccggganttcncggtacatgcaagcttgcatgtaccgggcttgcatgtaccgcttgcatgtaccgggcttgatgtggggaggggtgtttaaggggttggctagggtataattgtctgggtcgcctaggaggtctggtga

SEQ ID NO: 465734 - DNA, 1643 bp, Homo sapiens
gtcgtcccgacccccgggctcccgggtgggaaggagcagctgggctgcgcggagcaggcccccgtgagccccgggaaggagcgcagcgcagggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaagcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacgcagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtgaaaactttgaaatgtggtctgtaggggac

SEQ ID NO: 465735 - DNA, 1034 bp, Homo sapiens
ctggaccctgttggccctgagcctctggggcctgagagtctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacgcagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtgaaaactttgaaatgtggtctgtaggggac

SEQ ID NO: 465736 - DNA, 3059 bp, Homo sapiens
agtggagctgtgagaagagggccaccatcctccagaccccagaaagtcggcaggtgatgaatcctgccaggactgggtccatcctttcaaggcagcaggagtggggcactgctgtaaagatacttgaaagtatggaagcgactttggagcaggacaacaagacgaggttggaacagtttggagggttcagaagaaaagaagacagaaagatgtgggaaagtttggaacttcctagagacttgtggaatgattttgaccaaaatgctgatagtgatatggacaatgaagtccaggctgaggtggtctcagatggagataaggaacttgttagaaactggatgtggaagggaaatgtggggctggagccccgatacagagtccccactggggcactgactagcagagttgtgagaagaggtccaccatccttcagacctcagaaatgtagatccactgacagcttgcaccatgaacctggaaaagctgcaggcactcaatgccagcctgtgaaggatctgcccaaggctgtgggagcccactccttgcatcagccagccctggatgttgctaagcttggaaaaactgaacctgggaccagtgaccatcttcccagccatagtaaaaagcctgtttgcagaatgaagctgaacagagacaaaccatgatgagagacagatgcacattttaggtaacactgactctttggcaaccatttttcaaatatgaaataatgacagaaattatatatttattttttcagcaattaatcagtgtcagatactgttagatgctctcattaaaaatctttttcagtgtatagtagtatactaccatgagactatttatgaaacttctgacttagcagttttaaaaccaacgtttatctttcaaatatgaaatactcaaatattgctttgtgtacttgacaggtcagagaactattttcaaattatgacacaatttcagtgcaaagaccaagacagggcatggctggttgttttctagttatgtgtacatttccttacatgaaaaaaaatttaatgatttttactgaatttgaagtacatcagaaatttagcaacttgaacaaattctgaatatgaaagtaccagagtaatatgtgagcaattttaaggataatttcaaatagcgtttaaaggaaatattggaagaagtggaaacttttattatctattagtttttagatgcccattataagaatcagaaaacaagagcatagaattcaaagaagtgagggaaaaagtaaataaatgaaatttttaaaagaaaaaagaaaatgagcaattatgcaaagttcattgtaaagtgcctatgaaaacatttttagcatccctcacaatataaagttaatcttttcaacttattaaggaaagtatacccaattaataataataacatcaataataataaagacccaatcttggggacaaagaacaaataaagactgtgatcaccacaccatttgttaagacctctgatttctttaaagtggtccccattaaatcatttcacttgtacaacatggctcagggtaaagagaatgtagatttggcccaatggaaaccaatagagtctaaattacttgtaattcaacctagaggaaagtcttctaatcatggatctggctattggcaggaggagctaacaagaaacaaagatattaaagaaaccaacaatgtttttcaaagatttgcagtacccgaagtgctaccagtttgaacgaaacaacttatgactgagccgtaaactaccctcgagccctcgactttgtgtgagcagactgaatagctactcatcttctaagaagtgcattttctcctgaaaaggatattggaaagaaaggcccacccagaaggtgataccaagagccacggaaaatcatggactcaaaagctacctccagaaaacaaaactgagtattgatgaagcagctttcctactcccagattggagaaaatccaaaagtctgataacatactctgttgacaaagctgtgatgaaacaggcaccctaatacactgtttatggaaacacaaaatgttaccactcctatagagggtaatttgcaaatacatagcaaaattatgcataattaacaatcccatttcaaggaatctaccacaaagatacactggcaaaaattcacaaagttaggttcccaaggaattcactgaagtactatttgtaatagcaaagactggaaacaacccaaatgtttatccatagggatgggttaaataaaaccatcctgcatcaacacaatggagtactttgcagctataaaaaggaatgagtaatatctctagatattatgatctataggatataatcaaattttaaaaggaatgtttatgatatgctgacatttatgaaagtgaggaagaaacaacaaatttcggtgagaacgtagagcaacaggaattctcattcattgctgctgagaatatgaaatggtggagccactttggaaaacagtttagcagtttcttacaaaactgaacaaaatcttaccatactcttcagcaatcattccttagagtttatccaaatgaattgaaaagtcctgtccatacaaaaaccttcacacagatgtttgtaacagctttgttaataattgccaaaacttggaagcaaccaagatgttcttcagtggtgaatggttaaacaaacattggtacattcagacaacagaataatattcagcattaaaaagcaatgcactatcaagccatggaaagacatggaggaaacttaagtgcaatttactaagtgaaagaagccaacctgaaaaggctacatactgtatgatttcaactatataaaactctggaaaaagcaacactgtaaagataataaacgagtcagtggttaccaggagttggcagatggagagggataaataggtagagcacagataacttttagggcagtgaaactattctgtatggcattcctgtcctgagtaaaatgatgagtgcatgtcattcttcgtcaaaaacccatagaatgtaccaagagtgcaccataatgtaaacttt

SEQ ID NO: 465737 - DNA, 3592 bp, Homo sapiens
gggcacttccggccggcggcggctgctccgggtgagcaggcccctgaagtgctgtgcctggagataccattgtggaccctggagaggcacctgctgcttatgcggtaaaacctctaccaccccaaacctggtcagtttgaggggagccgctgccatagtatccacagagaaggccggagttccagccgtgtggagcagcagaggggagtctgacagggtcacctcctacacagagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctcggactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaacgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcggaggagatcctggtgagggcgaggaggtggcctgggagcaggcggccgtggcctttgacgcagtcctgcgctttgcggagcggcagccatgcttcagtgcgcaggaagtggggcagctgcgggcgctgtgtgccgtgttccggagccagcagcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatctccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaaaaaggaaataaaatagaaaattgccatctgcaaatgagaaagccttcagccgacaccagactgccagtgcctttgatattggactttcagtccccagatctgtgaaaaattaatttatgttgtttaagacacctagcctgtggtattttgttatcgcaatcaaaactgactgagacaggcagtaaggagagaacagaggttccagcctgcttcaggtccaggcagttctgccattgcccctaactcctcagtgccagtcatgggccaggcccctgggggacttggaatgagtaaaacatgcacctattgttaaggttcacctggtccagaaggggaggcagacccacctgcccaccatgacccggacagaggcaataaatacggagcacctcatggccagggcctggaggattcccaccataccctacccagcgccaataacagagggaccctggagttgtgtacgcaagatagcagttcagtgcttgcacacatactagttgagaagggaaatcagggctaatgaaacagctcaactgtctggcagagccaggttccttctgccatgatacagtttggatgtttgtccctttctaatcttatatggaaatttgatccccagtgttgaaggtggggcctggtgggaaatgttcctgttatcgggatggatccttcatgaatagcctggtgccatctttgtggtaacaagtgagttctcacttgattagtttctgtgagaactgtttgttaaaaagagcctggtggcacctccctcccttcttcctcctgctcttgctatgtgatgctgctgccctttgccttccgtcatgagtggaagctccctgaagcccccaccagaagcaaatgctggcaccatgctgcttgtacagcctgcagaactgtgagccaaataaacctcttttctttataaattactcagcctcaggtgttactttata

SEQ ID NO: 465738 - DNA, 2906 bp, Homo sapiens
agaaagtcagagtactgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaagggtcattccggctgcttttttgagaagtccctgaagagatcaataacagcaagagggaacctggcaaggaagctattcctataatccaggaaagagatgaggaaggcttggaccaggtggtagtggtgtcagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaaggagcttgctgtgagacagaagcagagaatacatagacttccgttaaaaccagaatgaggaaaatacttttctctagcatcgtaggaggaagaaaacaaacacatcagatattttcagcactaaaagagatggttttccccacatatatgtaaaagaaatttgcaagactactggattttgatctcatggttgcagtgggtgaataggtggccttttgtgatctcctacatcaccctggaagtgagacttcttcggtttcttctagagtcagtttggtatcagaatggcaaagcaacttaaccttccagaaaatacagatgattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcctgaaacaggaccaggcaatctcattgatccgatacatgaattcaaagccttcacaaatacagcaacagccacagaagaggatgtcaagatgaaatttagcaatgaggttttccgatttgcttcagcttgtatgaattcacgtaccaatggcactattcattttggagtcaaagacaaaccccatgggaaaattgttggcatcaaagtcaccaatgataccaaggaagccctcattaaccatttcaatctgatgataaacaagtattttgaagaccatcaagtccaacaagcaaagaagtgcattcgagagccaagatttgtggaagttttactgccaaatagtactctatctgacagatttgttattgaagtggacattattccacagttctctgaatgccaatatgattatttccagattaaaatgcaaaattacaacaacaaaatatgggaacaaagtaaaaaattctcactatttgtgcgagatgggaccagctctaaggacattacgaaaaataaagttgatttcagagcatttaaagcagattttaaaacactggcagagtccagaaaagcagcagaagaaaaattcagagcaaaaacaaataaaaaagaaagagagggaccaaagttggttaaattattgacaggaaatcaagatttgttagataattcatactatgaacagtacattcttgtaacaaataaatgccacccagatcaaacaaaacacttagatttcctgaaggaaattaaatggtttgctgtattggagtttgatcctgagtctaacatcaatggagtggtcaaagcttacaaagaaagccgagtagcaaaccttcactttccaagtgtatatgtagaacagaaaaccacaccaaatgagacgatttctactctaaatctttaccatcaacccagctggattttctgcaatggcaggttagaccttgacagtgaaaaatataaaccctttgat

SEQ ID NO: 465739 - DNA, 611 bp, Homo sapiens
agaaagtcagagtactgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgggtcattccggctgcttttttgagaagtccctgaagagatcaataacagcaagagggaacctggcaaggaagctattcctataatccaggaaagagatgaggaaggcttggaccaggtggtagtggtgtcaggtagtcaaatgctgggtatattttgaagatacaccccataggatttgctccacattgaatgtggaatgctggaagagagataaagtgtacctgtcacatactttttgagttttatttattttcttagaagtaagtacacaaagagatgctacctaggagaagggtattcttttcactattctttcaaattttctgtatgttcaaacattttcatagtagaaagttggggggaaaatctgtttcataaacatttcctcagcagcagtccagtctattgcattttaattggttgtgatatcattg

SEQ ID NO: 465740 - DNA, 442 bp, Homo sapiens
agaaagtcagagtactgggagaacagaagacttcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaaggtattgcatctcacccgagcagactgtgtctgtggaaagtgtaagccccttgccagaagagcagcttcccagcaaaggcagagggtgaaaacagcaaaggtcttaagacactggggacctagagtcaaaagggacctcctccagggaaaacgctgtgtgagaaatggcctcattcggtgactgtgagtgacacagcagaaagttggt

SEQ ID NO: 465741 - DNA, 2611 bp, Homo sapiens
tttatgcaatacgttctcaacaagtatatcctccggcaaactgaacaaggaccaagtctgttctgcctacagctctgcttcctcatagctgctttccagaacgtgactcttgcaaattatcaagaaaggggaactaatctaagggatccagatcaaacagcctcatgaagacttattttatgtttctaatataaagatagaagttttcagaaaagccctgctacacagaggatcagagcaggggtgggcctgctgggctgcagctgggattctgagcatcctttcccggaggcacggaaagtgagtgagtgagcccagtgaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacaccaaaaaggaagaagaaaattcaatgtcatctaatattgattatgatcccagagagatcagagatatcaaacaagaagaatcaattcttatgaaagaaaatgtgttagatgaagtagcaaatgctaaacacaagaaaaaggagcttgctgtgagacagaagcagagaatacatagacttccgttaaaaccagaatgaggaaaatacttttctctagcatcgtaggaggaagaaaacaaacacatcagatattttcagcactaaaagagatggttttccccacatatatgtaaaagaaatttgcaagactactggattttgatctcatggttgcagtgggtgaataggtggccttttgtgatctcctacatcaccctggaagtgagacttcttcggtttcttctagagtcagtttggtatcagaatggcaaagcaacttaaccttccagaaaatacagatgattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcctgaaacaggaccaggcaatctcattgatccgatacatgaattcaaagccttcacaaatacagcaacagccacagaagaggatgtcaagatgaaatttagcaatgaggttttccgatttgcttcagcttgtatgaattcacgtaccaatggcactattcattttggagtcaaagacaaaccccatgggaaaattgttggcatcaaagtcaccaatgataccaaggaagccctcattaaccatttcaatctgatgataaacaagtattttgaagaccatcaagtccaacaagcaaagaagtgcattcgagagccaagatttgtggaagttttactgccaaatagtactctatctgacagatttgttattgaagtggacattattccacagttctctgaatgccaatatgattatttccagattaaaatgcaaaattacaacaacaaaatatgggaacaaagtaaaaaattctcactatttgtgcgagatgggaccagctctaaggacattacgaaaaataaagttgatttcagagcatttaaagcagattttaaaacactggcagagtccagaaaagcagcagaagaaaaattcagagcaaaaacaaataaaaaagaaagagagggaccaaagttggttaaattattgacaggaaatcaagatttgttagataattcatactatgaacagtacattcttgtaacaaataaatgccacccagatcaaacaaaacacttagatttcctgaaggaaattaaatggtttgctgtattggagtttgatcctgagtctaacatcaatggagtggtcaaagcttacaaagaaagccgagtagcaaaccttcactttccaagtgtatatgtagaacagaaaaccacaccaaatgagacgatttctactctaaatctttaccatcaacccagctggattttctgcaatggcaggttagaccttgacagtgaaaaatataaaccctttgat

SEQ ID NO: 465742 - DNA, 499 bp, Homo sapiens
atagctaaagtaagtatcaagcagttttaagagtcagcctttagcaatattatacatatatatatgtatcttctgtatgataatgtatacataattgtctatgtgattttaaaaataaagtataattctaaaatacttattatattgctttgtctcaggaagaagttgaagctttgatatgagtaaacaagtatctctacctgaaatgattaaagactggaccaaagagcatgtgaaaaaatgggtaaatgaagaccttaagattaatgagcaatacgggcaaattctgctcagtgaagaagtaacaggattagtcctgcaggaattaactgagaaggaccttgtagaaatggggctaccatggggtccagcacttttgataaaacgttcatacaacaaattgaatagtaagtcccctgaaagtgacaatcatgatccgggacaattagataattcaaaaccgtccaaaacagaacaccagaaaaatccaaaacacacc

SEQ ID NO: 465743 - DNA, 1137 bp, Homo sapiens
agaattattttatttcaggaatccatcaacatcctttgcagctacataggcaggaaaatctagaaattgtaatttatatagaattttaaaactcttcaattacaatggatagaggggagaaaatacagctcaagagagtgtttggatattggtggggcacaagttttttgcttattaatatcattggtgcaggaatttttgtgtcccccaaaggtgtgttggcatactcttgcatgaacgtgggagtctccctgtgcgtttgggctggctgtgccatactggccatgacatcaactctttgctctgcagagataagtataagcttcccatgcagtggagctcaatactattttctcaagagatactttggctccacggttgcttttttgaatctctggacatccttgtttctggggtcaggggtagttgctggccaagctctgctccttgctgagtacagcatccagcctttttttcccagctgctctgtcccaaagctgcctaagaaatgtctggcattggccatgttgtggattgtaggaattctgacttctcgtggtgtgaaagaagtgacttggcttcagatagctagctcagtgctgaaagtgtccatacttagcttcatttccctaactggagtagtgttcctgataagagggaaaaaggagaatgtagaacgatttcagaatgcttttgatgctgaacttccagatatctctcaccttatacaagccatcttccaaggatattttgcatattcaggcggggcatgctttacacttatagcagccagcactgacggagctgcacctgatcctcctcaagttataactaaccacatttgtagaatgcacactgggaaattgaaggggaatttcctttgccttactggaaagaaatattttggaaatgtgactgaagatgtgaaatttgtggagaacactgaattccctacccatcttctccttccccagccaccttatacccaaaccttcccacccccaaagccaatgtcagggccatatgacctagatacaactactttccataagaagaccctccacccttggccaggcccattttaatgcaaaagtttcttaatttttaatgttataaacaatgcagtctttccagact

SEQ ID NO: 465744 - DNA, 1826 bp, Homo sapiens
gagggagtgacactgaatattaagggtctggaatatgatggtttaaaagtgtggcacatccccctttgcacttgctctctctctctctccttctctcctttgtctctctcctctctctcttctctctctctcgtcgccatgtaagatatggcttgtttctcctttgccttctgccataattaagacaagagtgcgagcctctgttatgcccggacagggccaccagagggctccttggtctagcagtaacgccagcgtctgggaagacacctgttgccaagcagaccctccactagacagtgccccagtggggagtctgtatgggggctccagccccacatttgccttccacactgccttaggagaggttctccatgagggctctgcctctgcagcagacttctgcctggacatccaggctcatattggcaacttattaacatcaaaattcttcagttataaggattttgatactttattatatacctgtgcagcagagtttgactttatggaaaaagagactccactgagatacacaaagacattattgtttccagttgttcttgtagtgtttgttgctattgttagaaagattattagtgatatgtggggtgtcttagctaaacaacagacacacataagaacacagcacatcacttattcatccttcagatgttatccagtacaatctgacagtagccctgcacataatctacactcgaaggacacagttttatacttcagttcagcagggaaagtaaattattatgtgagtggttttaggaccagtggactgccttttgggaaatgagcagggaaatataaaactggattcatacctcactttttgcagaaaataaatttcagatgaagcagagaattaggtatagaaaaaaaataaagccccaaaattaactaagagggataattaatcctttatttgggactctagcagaggccacattcttctctgggaagaagttttgcatgacagatgcatactactttatactaacaattaccgatgtattcttaatttggtttcagctatttggatggctcttttgcaaagtacatcctggtgctgttgtttttgctatattagcagcaatgtcaataccaggttcagcaaatctgcaaacccagtggaatactgtaggggagttcagcaacttgccacaagaatttatagaatggatcaaatatagtactaaaccaggtaaaaaaaaaaaagtcatattatttaactgtttttcccacaattttatataccactgcaaactccaaactcttaaaccctagttacttccactgatcttactctttctaagcaatgttgcttttagaatatctaaaacaaaggagatatcaatcctgtttaaatggtttgcatgggaaatgttatacatatgttcttagtaatttattctgccactttttatagattttaattttttcaaaatttattcacagtcataaatgccacatttaaaataattttactgtgcttatttttttaatgaatttttaatattagtccttcacattccttcttgaaataaactcatggaatgtggtattttattcatgtgtggaaagggagacttcgttgtcatctgagtatcaaatgattgaatactaaatcatcttccagaactctttgttactataaagctttcctagtccatttcatacttcttttctagattcaggaaagatttctaagatttttctttaaagaaagaaatctttaatgatgagatgatgaagctctattttccaaggaaaatagtttacccaggcctggctgccaactgctactttat

SEQ ID NO: 465745 - DNA, 1201 bp, Homo sapiens
accaaaggcagccccttaaccatggactccttagcctccatagcagtaagaaataatttctgtttctttataaattaccagattcagctgggccacaaatggagtctggtaattcatccccaactgcttcccaggtcgggactcagggcccctttccattacccgttgttgatgaccttgtctttgctttctgggccccagccttgtttcctgacaatggtttcagcaacaatcatttgtgacaagtttccagctgttgtcatgatttgtctggtaatgtggtttgaggctcttgaggaacctttgagcttaaaggccacattatcctggggtgcagacataccccatctggcatttcccctgcttgcacttactccattctgccgccctgtgaagagggtgcctgcttttcctttgccttctgccatgattgtaagtttcctgaggccttcccagcgatgtggaactgaaaccatgcattcaaaataatgctaacctgtcaagttattgatctgcactgtacatatttcctggtcataggcagcttccacacaagaacatctggatgcaaattaaagaattcaattactcaagcctaagtgatagaggagacctcggctactctgcctgagcacatcactgctggatctcaaaatctgcaagaacttcctagggcttcaggaactttcatgtgcataccagtcacctgggaatcttgttacgatgcatattctttttcagtgagcccaaattctgcaattcttataaggtcttaggggacatgatgtttgcttctagtggtccatggtctactcctgaaggtccaccatgcccagcttcatctccccaccctctggaaactctcctgtacccaagccacttgctctcttctaaataggcattgtgttcccatgttcccatgtgtctgcctctttcaacttctcctctaaaaattctccatgacccccaagcataagcctccagcagcaagctcaaaaatgctttctactctgttgtgttgcccggcccacttcaagagtagatgctcaattccttcttcccctagtcgtatttgctgctacttttgcaggctgctggaacactttcactctgaggattctgatgaacacagttcttgccctcttcacttttccaatctggttgcaggcacagcgggggacagcaggagtgcaacacagta

SEQ ID NO: 465746 - DNA, 2096 bp, Homo sapiens
aagcaccaacctatcaaggagaagtcccacccagtctgccctgtgcctatataaaggcgacaagtggcggccgcagcactcattgaagccgccagttgggagaggagcagagccaggccggtgctcccgaaggcagcaagatgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaagctggccaaggaggcggccccggaggcaagccgccatttgggagcggagcagagcccggccggtgctcccgaaggcagcaagatgttgcgagccacagctccctgctgcttcccacctggatacccagaagctaagaaggtggccgaggaggcggccctcgaggctccagaattcccactgccctctcatcagcctgcccagagcttcgggctctgggtgccccagatgcacaagcaggcctcagcatttgtggacatccaggcggagccccagaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagacgcgcaacagctctgggtgccaagtccccaccgtcctccgccgaggctatctccaactgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctcctcgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctcgatggcttcgtggagaccttcaagaaagagttgtccagagacgcttatccaggaatctacgccttggactgtgagatgtgctacaccacgcatggcctagagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccaggacggccacaactccagcgaggacgcaaacgcctgcctgcagctggtgatgtggaaggtccgacagcgcgcccagatccagccacgccaccggtccgcctctcccgccgccctggcctgtccttagccccaggcctcttccaaaaccgccatcagtccc

SEQ ID NO: 465747 - DNA, 1218 bp, Homo sapiens
ggcaccttgtcagctgcaaccaaacctcaccttctgaaagtgaagacagagaaatggtcaaatgggtatcagaaaaaggttatgggaaaagccaaacattggttgaatttgagctgactggaggatgcaaactacagccgcaggtccaggcaggtctaggaatttgtgggaaggagaagagaagagaaaaacaagagtgtgagacggatatcctctctgaggaggagaagagagaacatttcaaaaggaaggccgcagaactccgcagaaggccgcagaactccgcagaaggccgcagaactccgcagaagtccgcacacagtaaggaagttgcctccgcgtccagcccgctgattgagcaggccgagagccaatgcgcaaagaaggtccgtttccgtttgttttcctcatacttttccttctttctgaccagtaagccacagagttatggaaaaggctggggaagaatctgtggccgagtccttcttcccacaggtccactaattatggagaaccaaagttttttcttaaaactgacgggacaatcgatgaacctgaccactgcagacatggacttccctaaacttcaatctgtggagagaggcctcagagtcttcactcgctatttcattttcaggctccttccagcaaaataaaagtaaaaacaacagctatttgatggctcattgcctttgtttccctggtagatcctcagggacgttccaaggacattctactttgagtgtcatagaaaaagcaccagaatcacagtctgatatcttaagagtgacaagagaccagcattcaagacttagcttctgataatggtatgtatggataaagccacttgcttcctgcatgacaatggccaggttcttttacctctctgtgtctaaatttccatccttatttaaaggagaccttggagtagtgtttgaaattctgtatacaggattttattattattattgttattaactagataaaataccttgacactttggcctgagttacacttctgtttttgcaagaatcgttttaggcgattttctaaattcgtttcttgaatttactagcctgaattagttaataaataaaaactttccttcacaagctatttggatacttttaagataaaattcatacaggaaaggtaggataactatttttattctttcccattatcacacattgtattatcaaagcccagagagcttt

SEQ ID NO: 465748 - DNA, 1846 bp, Homo sapiens
gacaaggcccaatggctgctgttcggaaccagaggccggggaccggagaaaggaggagcggagaaggagaaggaggagagcacggcctggctgggacagaagcggtgggaccctgggaggcctccgctgtgcccgtgccgcgctcctcgggaccagcgcgtcgcacacaaaggggctgccgagccagagccaccagcgcctcagggcaccgtggggagcgcgcagctagggggcctgtgcgcaccccgccccgcagccccgcccccggccctccccggccccaccccactcccaccgccctctccgcggccgtccccacccctatctccgcgacccccactcctcctcggctgttccccaaccctgtcactgtgctcccctccctactcccggcccgtagtggaggtgactttcctgcgcagcgccgcttctgagggcggagaacccacagggagtgcgacccctttgcacgctgtgagtgggcaactgtccgagggactcgagccgatcgaaggctggacgccctatagggctcttggcagtccacgaaagacctggagtccgcctccccatttctccggtcggtgagtggcaggaggaaatcgccaaacatgttttcccgctttgcctccccaactcggaaacttgcaacttgccgtgtcctggaggttgagacaatttggggtctcttggctgccgtccaacagatttatctctgagggcagtgtccttggtgagaggtccaagtaggtgtgggcgacattttcctccatctcatgagggagcagccctgcacactagggcccaaaactctgcgaaggagcttggaagttcttcatccgttccacttgttttgctactccacacacccttctaggacatgttgattgccaactgctctgtgcagctttcccatagctgtctgttcccgtgcatttcggagcaccaagcaaatacgagcagagagacctggaaaaaaaaatgatgaagacagtattaatgataaaattaacatggctgagtgaattgtcaatgcaagttcctttactaactctttgttaagttttgctttgtactccttacatcctctttctcttaagccattgttttaatttcttctcgttatcatttttaaaagtaacagaaatacagctttcttcctaccttcacgattgacttggtggaggttgggttgcaaagaggaagcagtaagaaaaaataattattctatacattcacaagtccttcaaggcacaaaataaaagtaagaaatagaaaatatgtcctttctcctaataaaggtctttataataaaatttaaatgaagttttgtgtttcataacagcttcccaaatactgttgtagatactaaaatgtgcctgtatgtatttccttccacaataataatagtaataataaacttttttaggtccaaattaaacatttctcagcttaaatttctatcctcaatccaacatttattatatcaaaacttgatttttaaaaataaaactttcttaataatgtgtttgaaattcatccatactgtcatatccattggtagtttgctcctttttgttactaagtgttattagactatcagtataacacaatgttgtttattcattcactggttgaagagcatgtaagctctttcctgtttcaattattatgaataaagcagctataaaaatccaagtacaaacacttgtatggacatatgtttccatttcttttgagtaaatatctaggaatgtgactgctagattgtatggtaaatgcatgttaaattgaccagaaactgccaagttgatttcagaagtgactgtgccatctttcattccca

SEQ ID NO: 465749 - DNA, 406 bp, Homo sapiens
gctcccctccctactcccggcccgtagtggaggtgactttcctgcgcagcgccgcttctgagggcggagaacccacagggagtgcgacccctttgcacgctgtgagtgggcaactgtccgagggactcgagccgatcgaagggtgaggaccagctcgcctgggggtggacggcctggaaaagccgcccctctttggcttccctctgccgcctgcagcccgcacccctccgagattcgtgccccactggacggtttgcgaaggctgaggctgccttggggactcacaaaagaccacaggggtgattcgaagtgtaaatagggaaacaatcatcagcacacaatccggctaaagggataacatatgagtttgcttgttgtccttcatgggattcttctctttttatag

SEQ ID NO: 465750 - DNA, 326 bp, Homo sapiens
tattaatgataaaattaacatggctgagtgaattgtcaatgcaagttcctttactaactctttgttaagttttgctttgtactccttacatcctctttctcttaagccattgttttaatttcttctcgttatcatttttaaaagtaacagaaatacagctttcttcctaccttcacgattgacttggtggaggttgggttgcaaagaggaagcagtaagaaaaaataattattctatacattcacaagtccttcaaggcacaaaataaaagtaagaaatagaaaatatgtcctttctcctaataaaggtctttataataaaattta

SEQ ID NO: 465751 - DNA, 1439 bp, Homo sapiens
gacaaggcccaatggctgctgttcggaaccagaggccggggaccggagaaaggaggagcggagaaggagaaggaggagagcacggcctggctgggacagaagcggtgggaccctgggaggcctccgctgtgcccgtgccgcgctcctcgggaccagcgcgtcgcacacaaaggggctgccgagccagagccaccagcgcctcagggcaccgtggggagcgcgcagctagggggcctgtgcgcaccccgccccgcagccccgcccccggccctccccggccccaccccactcccaccgccctctccgcggccgtccccacccctatctccgcgacccccactcctcctcggctgttccccaaccctgtcactgtgctcccctccctactcccggcccgtagtggaggtgactttcctgcgcagcgccgcttctgagggcggagaacccacagggagtgcgacccctttgcacgctgtgagtgggcaactgtccgagggactcgagccgatcgaaggctggacgccctatagggctcttggcagtccacgaaagacctggagtccgcctccccatttctccggtcggtgagtggcaggaggaaatcgccaaacatgttttcccgctttgcctccccaactcggaaacttgcaacttgccgtgtcctggaggttgagacaatttggggtctcttggctgccgtccaacagatttatctctgagggcagtgtccttggtgagaggtccaagtaggtgtgggcgacattttcctccatctcatgagggagcagccctgcacactagggcccaaaactctgcgaaggagcttggaagttcttcatccgttccacttgttttgctactccacacacccttctaggacatgttgattgccaactgctctgtgcagctttcccatagctgtctgttcccgtgcatttcggagcaccaagcaaatacgagcagagagacctggaaaaaaaaatgatgaagacagtattaatgataaaattaacatggctgagtgaattgtcaatgcaagttcctttactaactctttgttaagttttgctttgtactccttacatcctctttctcttaagccattgttttaatttcttctcgttatcatttttaaaagtaacagaaatacagctttcttcctaccttcacgattgacttggtggaggttgggttgcaaagaggaagcagtaagaaaaaataattattctatacattcacaagtccttcaaggcacaaaataaaagtaagaaatagaaaatatgtcctttctcctaataaaggtctttataataaaatttaaatgaagttttgtgtttcataacagcttcccaaatactgttgtagatactaaaatgtgcctgtatgtatttccttccacaataataatagtaataataaacttttttaggtccaaatta

SEQ ID NO: 465752 - DNA, 1895 bp, Homo sapiens
aagcatcgcgtacctaattggtacgcgttccaaattatttttgaaacctaggaaaaagaagtctcatgtggaagttcttagggaaaaatgatgggcagctcatacttataattagtcttttcacattacttaatgttttaacttactttttctttggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatggtgcaatgcacattttatctatttatttagttgcattcaccatgaaggaagaggcactgagatccatcaatcaattggattatatactgatcagtagctgtgttcaattgcaggaatgtgtatatagattattcctgagtggagccgaagtaacagctgtttgtaactatcggcaataccaaattcatctcccttccaataatgcatcttgagaacacataggtaaatttgaactcaggaaagtcttactagaaatcagtggaagggacaaatagtcacaaaattttaccaaaacattagaaacaaaaaataaggagagccaagtcaggaataaaagtgactctgtatgctaacgccacattagaacttggttctctcaccaagctgtaatgtgatttttttttctactctgaattggaaatatgtatgaatatacagagaagtgcttacaactaatttttatttacttgtcacattttggcaataaatccctcttatttctaaattctaacttgtttatttcaaaactttatataatcactgttcaaaaggaaatattttcacctaccagagtgcttaaacactggcaccagccaaagaatgtggttgtagagacccagaagtcttcaagaacagccgacaaaaacattcgagttgaccccaccaagttgttgccacagataatttagatatttacctgcaagaaggaataaagcagatgcaaccaattcattcagtccacgagcatgatgtgagcactgctttgtgctagacattgggcttagcattg

SEQ ID NO: 465753 - DNA, 2064 bp, Homo sapiens
cgcagcactcattgaagccgccagttgggagaggagcagagccaggccggtgctcccgaaggcagcaagatgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaaggtggccaaggaggcggccccggaggcaagccgccatttgggagcggagcagagcccggccggtgctcccgaaggcagcaagatgttgcgagccacagctccctgctggttcccacctggatacccagaagctaagaagcctgcccagagcttcgggctctgggtgccccagatgcacaagcaggcctcagcatttgtggacatccaggcggagccccagaacaggggtccggcggtgcccccagcgtggcccaagatggtgacggagtcgtgctacttccctgcacagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagacgcgcaacaggtcagggatggcatgcaagaccaccgccaccaccagctctaagcgaatcgtccgtcgtccatccttaccgagtttgagtttgaagaaacccattatcctccgaagctctgggtgccaagtccccaccgtcctccgccgaggctatctccaactgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctcctcgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctcgatggcttcgtggagaccttcaagaaagagttgtccagagacgcctatccaggaatctacgccttggactgtgagatgtgctacaccacgcatggcctagagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccaggacggccacaactccagcgaggacgcaaacgcctgcctgcagctggtgatgtggaaggtccgacagcgcgcccagatccagccacgccaccggtccgcctctcccgccgccctggcctgtccttagccccaggcctcttccaaaacc

SEQ ID NO: 465754 - DNA, 1325 bp, Homo sapiens
aaggggcgctacggggtccggcagagcctgtgcacccccgctcgctacgagggtacctggagtaacgggctgcaagacgggtacggcgtggagacctacggggacggaggtacctaccagggccagtgggccggaggcatgcggcatggctacggcgtgcgccagagcgtgccctacggcatggccacggtgatccgctcaccgctgcgtacctcgctggcctcgctgcgcagcgagcagagcaatggcagcgtgctccacgacgccgcagccgccgccgacagcccggccggcacccgcggcggtttcgtgctcaacttccacgcagacgctgagctagcgggcaagaagaagggcggcctcttccggaggggctcccttcttggaagcatgaaacttcgcaagtccgaatccaagtcttccatctcgagcaagcgcagctctgtccgcagcgacgcggccatgagcagaattagttccagcgatgccaactccacgatcagctttggcgatgtagattgtgatttttgcccggtggaagaccacgtggacgccaccaccacggaaacctacatgggcgagtggaagaacgacaagcgcaacggcttcggcgttagcgagcgctccaatggcatgaagtatgaaggggagtgggcaaataacaagaggcatggatatggctgtaccgtgtttcctgacggctccaaagaagagggaaaatacaaaaataatattctggtccgtgggataaggaagcagcttataccaataagacatacaaaaactagggagaaggtggacagagcaattgaaggcgcccaaagggcagctgccatggccagaaccaaagtggaaatagcaaattcaaggtaagtaaatgcagggtggttggttttgctgggttggtcagaacaatggagtatcaaatattatgtttgtctatctgccagtgacatcgctaaatgctttctacaactactaaaaaatcaaaggtgaaaaatgattacactcagtagaatcaaagtcagaaatgtacctgcactgttctgaaacttcccatcatcaaaaaatgtcgaaggcactttgagctccccttcctgttctaaattacttccctcatatttaacagcgtgagggagttcactgagaccctgtgctcatcttcctgagcccggaaagttgctgttttcttttcttttttttgtaagaaggacctctgaaatgctgccatagcaagcattgtgttttgtgtaccaaaagaaaatagcaatccacgtagaaacatacttagtatagatgtgtacctttattctgatatttacatc

SEQ ID NO: 465755 - DNA, 674 bp, Homo sapiens
ccactcaataaaacgtgttaaatgaatgaatcaaagaatcacataacaggcctcaaatcatcttttaatcctcaggagacctcattcccaaggccattggtgaattccaaactcacggattcacactgccttcccggtgacgaactcccagagctggccgcaggccaacctttcccctatgcacactcgggtccttgtgcacgggagccagacaatctggcctggggaaactgcatgggccacctacttccaggccacgtggacatagtctttgtcccagaatccagaggaaaatgtgccacttgtgcactgggctccatgcatagacaagccccatgcttgctttattgctctgctcttaccatcttgaaattcataatcattgtcaaacaaagagtcccatgttttcttttggactgggccctgcaaataatgtagctgtacatggagctgatgtttgtaagcaaagcattctgttattttcagaaggaccactcaaatgtgtctggaaaagaccaaacaaccccagacggcaatggtctccaaggaaggtgaccatgagagaacagggaggtgaacagtacgcaaccaagtgaagaggaaagtgtggctgcttgcaccatctagcagcctttcttgttcagtgcacctcattaaaaccacagaaaatgatt

SEQ ID NO: 465756 - DNA, 1206 bp, Homo sapiens
tcatagagccagaagattcaagtaaaagtcttgccaaacaagaaaaggagaaagttcatttttgtcacagtctggttgcaacagtaaaaactagcttttgtcatcatcacattttctaatatcgaaaggacatattttaggaaaaagcatcccaaatttatagaaagacatgatgacccaatataatggcccccaggaaactagcatgacattggagctgaggacccttcttctcactggaggggaaaaggctaagaaaacagaaaaccctctctgttcttgtgaacttgctttagcagataatatcatgggtgggatacctggagagggatcaaaacctcacagcccagacttaaatatgaagactcagcatatgatatcggtgacgttaataccttcccagggagaagcgctgttccttctggctgggaagtgcgagccggtggggggagagagaggagtagagcattatgtggaggtacttcccggttcccttgcgtctgagggtcttatgccagaggggatagaaagcccaacagaaactcaagatagaagaaggagaatctgcgagtgtctgtctcctgtcaagcttccctaatacagccctggtagaacttcatcaacagtggaaggcatttgcaaagagatgtcatcctggggatgagaaggaggaagacagagaaacgcagaaaagcctaagcaggcaccacaaagagaccgagcccgtctgaaagaggctgctctaacctggtggaaactattttaagttgccaccagacattacattccagagccttgagaaaaactgatgaaaaaaaagtcatgaaaaaaaagtcattcgcacaagtgacaccatggtgtgaagtcaaggagcgcagactctggagtcagagggcttgagtcaacctgagcatcttcagctttgactgtgaagacacagctttgactctctgtgttgcagagatggtagtgcccactccagtgacgcttgtgaggattagttgagataataaatacaaaatgctgagcatcaaacctagagtagagaaaggtctcaagtaagtactcattaccagtatttgttatttaatttcacttttgtctacattcccttgtgtgaaatggtttggataattaattaaggaaaactttccctcagggacattgctgatattgcaatcttcactagatacacttatctctacc

SEQ ID NO: 465757 - DNA, 1485 bp, Homo sapiens
ggatttctgggaaagaaaccactctatctgctggacttggagttgaagactgaggagcagcggcagccatcttgccatgctgtggcactgagcatgaagccatcaggccggaagtggagccgaaagttgagactagagaccaggcgcagtggctcacgtctgtaatcccagcactctgggagactgaggcgggcagatcacgagacggaagtttcactctttttgctcaaggtggagtgcaatggcgcgatctcggctcactgcaacctccgcctcccggattcaagcgattctcctgcttcagcctcctgagtagctgagattacagacatgagacaccgcgcccggcctaaaatgtcattttcttcggtgccacggggaagtgaaatagtcctgaacaaaattatatatcctatctgaggttgggatgaggcacagaggtgggaagaaaaagtccacagtcaagtacatgggctggacataaatgagagcaagactgaaatgctgagggggctgcagggagaggcacaagttacttgcatatagcggtgataagcctaagtgaggcaaactgaagtcctcagggttttctatgtttttgttttccatgtggctaaaaattctgtgatttttgtatactactgcagaaatacagaatcaggtcttttatttcataacttactgacactggcttaatttctttgcacagttctaccctatttccaaaaagctaaagagaggaatgtgctagaccaccctccctgcctcactatgccatagtctcttttgggcacacattatattcctatccatgacaagcagccagggcagaagagctctctacatatgtgccaccttgtctccaaaacctgctgtcccctttggacagactggcccatccctgaccactgttctcccctgtcttcaattcctgatggcaacaagagagattctctgactgtttccaaggatgtcattctcagcctcacctccaagtttgattttatagaacaaccaataaatgtggtttcaccttccttgagttcacaaccattctccaaagtgtattcagaagaacacgagtcctgggagatgcttggagagccttttctcacattttatgggcaagaaatgatttttaacgttgtgttaacattcttcagagcagctgctatcatggagctgggactgagtcattctagaaagggcacacatttaccttccatacttatatatttagagcgtctattatctaactttgcctgctagtattgttaactaggtacatatctgacacccccactatttcatacttccacatttcaacttaaaccagtaatgataaaaatttctcctttactcacttccaggtctgtatgaatataagcaaggtttctagatatttcttaaggtagcattcagtcattcatttattcaacccatatttaccccctctaccaactaggcactatacatgttctgagc

SEQ ID NO: 465758 - DNA, 1109 bp, Homo sapiens
gaccactaccatcaagacgtggagactggtagtggctctgaatggctgggcgtgctgatatttattgcatacaagacaagcggggcagggatctgggaacagagatgaataaaacatggtccctcagtcttcagcagctcataaagaactgggaaaaacagagttgcaaggaactcacagttgaaacaaagcatatgatcatccgtgtaagccactctcgggctcagtatcaatatgagcaaaatgagaacaaaatggtgagtgctgcctaccccacgggcatgttaggaaacttgcatgagatatttgacagacaggagtgtgaatttttaagtcaaatagatgaggtggagatacccagggaagatactggcaaatcagcagctctcaatggaagagtaaacgtccatgatgtgattgcctctccctcttctgcttcctctaatctctgtccctgccagtctgggtcaagtttctggcacctgacttgtttgccaggaaaaagacaactgcgggtgaaggagaaaaccctttcctgcatgctcggctgccttcggatccaacgctcctagctgggagatgggaagctgtgggctgcgcagtgggtctttatggtcttggaaaggggacaccccaccttgtgctcatctttgtagaatctgggcaagtttgggggtcctcataaagattttgaaatttttgaagtctattctctgcctgtttttctaaaaaattcttcagtaggtgaataatttacttaacattgtgtacttgggagaatatgatgatggggacagagcatgctgcattgcatggcttcttaggaagaaaacactatgggctgccctgcagaaatgcaggcagaagctgtcatcagtgaatgttgggaggatccataatgttggattggaatagaactagagtgagactgtttcatgaggccttctcccatctagaatctttctcaggagtattctggatgctttgacctggatcagttactgctttggtttgtggcaacatgaaaactggcacaacaggacaaaaatgagttgattatttcagctgaacttcctgggagtttcattcacaataaaggagaggcagaa

SEQ ID NO: 465759 - DNA, 1108 bp, Homo sapiens
cttaaagaaacatctttgggttcaatatccaaatgaacgtgacatattttaaagtggtcaatttgagagagtgaccacttaatccagtgattttactttgcttggaatacttttaaaacttcaattttagagttgcctttagtggcacttattttaaaaacaacattaatgatgacaaatatttttcttgaaaatacattctgtttgtgctccttgagtgatgattaaaactggaaattagccattagtgtttccattacccactatcaaaaaatatgaaaatgggaacacatttggagacactaatgcatgaatctcaaaatgagcttaggttgtcacagtgaatgacgcacacaatgaaatggtaatctgagggatcagtccaacccaccagtgcctttgatgtggtaaagtcatcagaagaagagttcctttacgttagtggagttgcttatatgattgtcatggcaaacgtagagtatttccagttaacaatgggaaccagaaagggatttactgacattcctggacctagctggtttgtacagcaaagagaagagaagatgttgaaaggcagaaaagccaaaagacagggtttggggaatcagtcacatctgttttggagtcagaatgatgaagatgaagggattgaagatattgaaggacttctccttagttcagttaaagacggggttctttgtcccacaccgacgaaaattcaggctcgcagagaatttgaatgggtacaaaaaggcttcatatggcactgctacaaacactggcatttgtgcttcaccagctttacgctgtggagagaagatcaaggggtcaagaagagccagggcactcctgatgaataagaataaggttaagagaatagctctaccaactaccaggcctgctatcaagctaagctaattaaaatagtgtggtcttagtgcaaagaacagtcaagggcatgtcttctattgctcttttccttccttattatctaacttatcgacaatatgtctcagatgcacaagtgtagagaggggaaatgcatgcttctaaggaggaataggctcatatggcatagaatcgtaggatgaaggactgactctgggag

SEQ ID NO: 465760 - DNA, 2218 bp, Homo sapiens
ggctttagcaaaatcatgccattttgagaggttggcagcttcgaccggcaaacagtgcccagagaggcctgcataagccacagagtggccagacccagcttgtctctggtgttcttgcgttgtctctgacggtagtgtccctctgactagtgcaagatgcatgaccttgggcaagtctcataactttctgtaagcctgcacatttccttgtgcaatgtggttgttgagaggagctctgctgcctctccaacagaccttaccaaaacagagagggggtggagccctgctgtctctccagcagaccttaccaaaacagagagggggtggagccctgctgcctctccagcagaccttaccaaaacagagagggggtggagccctgctgcctctccagcagaccttaccaaaacagagagggggtggagccctgctgcctctccagcagaccttaccaaaacagagagggggtggagccctgctgtctctccagcagaccttatcaaaacagagagggggtggagctgagaggacgactcggggctcatagactccgggctcatggcctcggggctcatagactcggggctcatggactcggggctcatggactcggggcccatggactcggggctgatagactcggggctcatggactcggggctcatggactcggggctcatggactcggggctcatagactcggggctcatggactcggggctcatagactcggggctcatggactcggggctcatggactcggggctcatagacttaaagggccacaaagagcagatgggctgggagaggctgttgaaggacctcaagctgccgccccaggctcttgcccttgcccctgctgggagagtcagagccgcctcctcctcctcagtcagaatgactcagatgcccgcgtcagacattctcccctccccaccagcctgggtgacgtctctccgaaactgtctgctccctaagacacagcttacaggcaagatgaagcagtgtcgcacagccctgtcgcctcactcatcctgccctcaggtcttgtttctgcctcttcacagcaccacccccatgaagcttccacatgcacctctgcagacccatctcgcacgatgcagtgggagcgagcccttgtggtgaggtgacaacggcccacatatccctcagtgctgggggatgggagtgtgggttccggggaccactgtgtgcagacacccgtagctcaggagtccaaatgccaatttgtggctggcattccatgtgaggattcaagaacccaggctcctccatcctccatctccaggggctctggagtccttcacttctagccaatgcatgaagaaagagaatagagaattacctgtgggggaatttcagtacgacgtctggaagggacacccacttccactcacctcccattggctagaactcaggcgcacggccacgctgattgccgaggaggctgggaggtggggctggctctgtgcccagggaaaagagagaacaatttctgtaagtacgtagctgtttatgtcacagtatttaaaaaaagagtttgttccataaaatagatgaaactctaactaaaaaccagatcacattaaagagtaattatgtttactattgtgggattctttgcttttaaaagatctagataaattgttttaactagaagctctcccttgctagtgcatttaatcagccaatcagcccctgttttgcctgggtctttgctggatcgggcagatgggatattatttgctgtctgctgtcaggtctggtttctctgagcatcctggttttcccatcctgtctgtcccatggaatgcagtgctttcagatgattttcccctggatgtatgagccagtcactgtcctggtttcaccctgttagaattcttgccttctctttggagggaggagcagggccagccgagggacacaggcagggaagctaagagcagcagcagctgatgctggccgcgtccttgcctgacccaagcacacagactcattttaacagcctccagtgatgtcctcgccccatcaccgatggctgccctcctgcctcttcttcagcccagcccccttccttcttctcattctttgggccaagtgggtttaatgggctggcctcgtcctgggcttctgctcctggaagaggggaatggatgtttaattctctttcctctgtactttcacagcccccagg

SEQ ID NO: 465761 - DNA, 1441 bp, Homo sapiens
tatttaccatttttagtgacatttatactttagtatttttcatattgttagttagcatttcatcatatcaatgtgaagatttcttccagaccatggctggagaaggaaagaaggtgtgttttgcctgattcagggactatagagagaaccaagttctgcaggcctgtcacctaagtctcagatgagtatgaattcttttgtgtttttcacagatttttgcagtggcaggaccaagttcaaatgagtcatagccaagtctacagtaagatgtggtagtattctgttttgaaccgaggaccatgattggcaagcttgccacttggtcaagtgcttaccctctaaagatgtcttccttggtctttgcctccagctgggtgtcacaaactctgaactggattctaaggctttcatgaatgcacttatgtttcctgtggcagctgcattatgttgtgggggatgtgcatgccgaacctcccattctgtcgtcttgcttatgttactctcctttatgtttcactttctcaaatgaatgtcaagctggtgatttttagattcaaaaattctaaaataaattgctcaaatttccacattatgtaagctattaataaaatgtcttgtaggtgctacatattcattaaaatttttggttgtaattttaagctcactgcaggcagaaaggaatcattaacatttatattcttttttttagtctgtatctaaatgatggtatattttaattccagatatttactttatactgcagtaatgctcgtcatattttgcaaaatttatgttgttcttttatttggaaatataaggcttttttagctcctgaaatctatattatagtcatataattttattatgttttgtggtaagaagtgcagcaacatattgagaacataataaaattatcctgtatttttaatgattatttattaaattcctctcattagagcctgttattaatgattgtaatgtattttctgtataattttactgcaatttattaaattctaatgacttaaattgtctgcttttcatgagtgcacacagttgaatgctgtagatatctaaagaattatttttcggccggttgtggtggctcatgcctgtattcccagcaccttgggaggccaaggcgggtggatcacgaggtcaggagatcgagacaaccctgactaacatggtgaaaccccgtctctactaaatatacaaaaaattaaccgggcatagtggcaggcgcctgtatccccagctactcaggaggctgaggcaggagaatggcgtgaactcagtggacagagtttgcagtgagccgagatcgcgccactgcactccagcctgggcaacagggcaagactctgtctcaaaaaaaaaataaaaaaaaaaacggttattttccattgtaaatctatgttgtattcaggattttatgcac

SEQ ID NO: 465762 - DNA, 1009 bp, Homo sapiens
aagtctgacctctgtgaataattacttcagcccctgattgctcccgggacaagctcctgcgccaagctttcactttggcttctgataagtcctgggccaatctaaatagcatctatgaatcatcccttcagctcctgattggtcccgggccaaagtcctgggccaagctgagccacacttttttcaagacagcctgtgaactaagcacatttccttctcttcctttcccagtccataaaaaccttgggccccagcctcacagaggtcaccccattcagaaactatctctgctggcaaagagctttcttctcttgcttatcaaactttcactctaacctcacctttgtgttcacgctccttaatctccctagaagtagaacaaagaactttcgatgctatctcagactatgagagactgttacatcttggtgcactgctgagactacaacacttggtttctttgagtttgactaaatattttacataggtgtaattatacagttttcctttttgactgtcttgttttacttaacagaatgttttcgagatttgtccttattgtagtacttttcaagatttccttatttttaaggctgctgaatgctatcccagtgaatatacgtgccctgtttgttgaatctactcatccttaaaggtacatttgcttccaggtagtatgtttgtgagtaatgctacagtgtacataaatgtgcatatatctattccatgttctgctttgcctgtttgggatatttttcacacactgatttagtaccatgtgtattcccttgcttttgttgtctgattcgttgatgttacatcccccaaattattgccgagaccaattgtcatgaagcttcacccttctgtattgtgctaggaattttacagctatagattttacattatagtcttcatattttaaaattgacacatgtaattgtacaaattttggggaaacaattatgtatatatgttgtatagcaataaaaatcagagtacttagtgt

SEQ ID NO: 465763 - DNA, 642 bp, Homo sapiens
aagtctgacctctgtgaataattacttcagcccctgattgctcccgggacaagctcctgcgccaagctttcactttggcttctgataagtcctgggccaatctaaatagcatctatgaatcatcccttcagctcctgattggtcccgggccaaagtcctgggccaagctgagccacacttttttcaagacagcctgtgaactaagcacatttccttctcttcctttcccagtccataaaaaccttgggccccagcctcacagaggtcaccccattcagaaactatctctgctggcaaagagctttcttctcttgcttatcaaactttcactctaacctcacctttgtgttcacgctccttaatctccctagaagtagaacaaagaactttcgatgctatctcagactatgagagactgttacatcttggtgcactgctgagactacaacacttggtttctttgagtttgactaaatattttacataggtgtaattatacagttttcctttttgactgtcttgttttacttaacagaatgttttcgagatttgtccttattgtagtacttttcaagatttccttatttttaaggctaatgattgcatttagacaatggttatatcgggatcgcgatttttctt

SEQ ID NO: 465764 - DNA, 3225 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465765 - DNA, 3285 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatggctgaatgctatcccagtgaatatacgtgccctgtttgttgaatctactcatccttaaagatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465766 - DNA, 3026 bp, Homo sapiens
aagtctgacctctgtgaataattacttcagcccctgattgctcccgggacaagctcctgcgccaagctttcactttggcttctgataagtcctgggccaatctaaatagcatctatgaatcatcccttcagctcctgattggtcccgggccaaagtcctgggccaagctgagccacacttttttcaagacagcctgtgaactaagcacatttccttctcttcctttcccagtccataaaaaccttgggccccagcctcacagaggtcaccccattcagaaactatctctgctggcaaagagctttcttctcttgcttatcaaactttcactctaacctcacctttgtgttcacgctccttaatctccctagaagtagaacaaagaactttcgatgctatctcagactatgagagactgttacatcttggtgcactgctgagactacaacacttggtttctttgagtttgactaaatattttacataggtgtaattatacagttttcctttttgactgtcttgttttacttaacagaatgttttcgagatttgtccttattgtagtacttttcaagatttccttatttttaaggctgctgaatgctatcccagtgaatatacgtgccctgtttgttgaatctactcatccttaaagatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465767 - DNA, 2630 bp, Homo sapiens
aataacaaacaaaccagttttattgttttaatagccgaaattggcaaaatttctagtttttctttcataggaatgctctttgcaagaaaaaattttcatatagtgagagcaaaaatggcaaccatttgcaagtaaatgtcttatgaaattaagtagcagatatcaagctcatgaccttcagatagttacccctaactcaatcacttacatagcaagtgcagataattttcatagctccctattaaaattatatttcaatgcccttacaaattgtgactgtttttaaataaagttgaccaactaaaattttgtatatgacatatgataaattccccttcaagtcaccttacatttacttaattttattaggcagtgtctgtctaccacccaataatacttgaggattctccctccatttgcacaggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465768 - DNA, 3241 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaatcaaataaatacttgcttcttacactgtcaatgaagcactcaatatctttccgtctgatattttataatttatcaattgctcttactcaaataaacactttgcaatttcattgtgtctcaaattactttttagcagaataaactaggaataaatattacaaaaatatctacggaatatggaaaaaacatagaaagtttatgaaatatatgaatgtagacataagcaaatagacaatttgtatcatattcttaggcagaaaaactcaatattatcaacatcaattgtccttatagttatttataaattcaattttgttcctatactgataccattaaatattgcaagtacacgttactataaaatgttatatagatgaaaacacaaacaagaatagacaag

SEQ ID NO: 465769 - DNA, 2043 bp, Homo sapiens
ctggagtatgcactggcaatgggtacacagaggacttcaattttatttgtcaatattgtattgcttatttagcacccggtaattccggggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465770 - DNA, 2063 bp, Homo sapiens
agttttcccagcaccatttattaaataaggaatcctttccccattgcttgtttttgtcagtttttttcaaagatcggatggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465771 - DNA, 1817 bp, Homo sapiens
aaatggtccaggctggtaccggcccggagtgttacggattgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465772 - DNA, 2640 bp, Homo sapiens
  misc_feature (2230)..(2230): n is a, c, g, or t
  misc_feature (2232)..(2232): n is a, c, g, or t
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaananaaaaaaagaaaaaaaaaaaaaaaatgttgtgggggcgcccgggccccgggaaaaaagtttttaaaacccactcgcggtggggggcgggggcccccaaggtgttatgggaaacctgggccaacgcgggtcccaagaaaaaaccggggccgaaactaggtggcggggttctccccaataaaaaagcccggggaccggggggtttgaaacgccaaaggcgttcgggccttacgggctttacaccaggggtcaaggaccataaccgccccgggcagggtcaagataacacataatatacagaacaaaaacccctagtaacaacacgaccacagacgcaagaaccacagacagaaccgtactaggacacacggcaacaaaaatcacataaccaacctcagaccacgaccgaat

SEQ ID NO: 465773 - DNA, 798 bp, Homo sapiens
ccttttcatcttttgttgataatgcttggaagacctgtcctgcattcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465774 - DNA, 2584 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatggtaacttcttagaccaagtctagaaacaatctgaggacaataacaattccattctaaaaagaatctcccaacatttcttctgtctcaacctcaactgcatctgcctgtgaacttccagcttaccaaggctctatatcttctggcagtgacaaaggctccttccatgattggtatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaatagggcaagaaagctttctaagaccccgaactccagatatgcgatggggcaaatcctgaagcgtacatggctatctctcacagctaaagcatccctcacccctatccagcgcttcttacccctggcgcaagagaatcacctgcggggaggaaaactttcaaaatcccttaaacccaagttgtaaccgcacaactaaatcagaatccttggagctggatctgaaaaaaatacggttgaaagtcgtgcaggtgattacaatgtgtaggcaaaccagaaaaccatggctttaaccagcagcttttgttagaaatgatttctccaatgaatgtagaaacgtttgctgctgaattgtgacctttccattttacctgcttttcctgcaaagtatattttgcagacccaggcagtgctgctcgctctgttcctggttcacccagtgccgtgtgtgctcagtgcatcctgtgcacgggtcactgtgtgccctggcctgggtgagcatcattcttcggggagaaccttgatgaaaacaaagctgcattccaaaaagttaaaaccgtgctacttactgtactgaggtaaaaattaaaagacctaggggactcttccaaaagttaaaacgtaaataaatatcttgtaacattaatatacacctgacgatgtcctgagtgaacacgccccactttaaaacaaaacaaaacattactattattctaaaatattaatttaggattgttatgcaaatatgtactatttaaatatttattgatgaataacatgcatacagcaatataggaacaaaatatttatggaatgcttgatgaattattactaaataaatacacttgtgtatgtaagaatcagatttgctcatgcccttgacactttctccttcccaaaggtaaccaagaccttaagagctaagtgtagataaactttgtcattttctacacgtgttttattacagaacattaaaaacgtatacataatacaaaaaaaagataacagaccagtcacccagatttaacagctactagtcatgtgtcatttttgtttcacctatacttccagccattcccaccccaatttcattattttttagcctttttggataaaatgtatattcattgcaaggtacaatgtgaactgtaaatagtagagagatggggtttcaccatgttgaccaggctagtcttgaactcctgtcctcaggtgatccacctgcttcggcttcccaaattgctgggattacaggcataagccaatatactcagcctgagaattcatacttctaagaaagtacaaatccatagggcacatgagaactgcaatgtctatctacagtaaatacagtttgatgaataaaatgaaaggcaattgacctaaggtgaaaaaaaaa

SEQ ID NO: 465775 - DNA, 1530 bp, Homo sapiens
acaccactgcactccagcctcactgacagaacaaaactctgactcaaaaaactgatctctggaaaggcattttctttttctgtaacgtagccaaatagctaaatttgtattgaagccatcctttaatttttaacaggggcaagaaagctttctaagaccccgaactccagatatgcgatggggcaaatcctgaagcgtacatggctatctctcacagctaaagcatccctcacccctatccagcgcttcttacccctggcgcaagagaatcacctgcggggaggaaaactttcaaaatcccttaaacccaagttgtaaccgcacaactaaatcagaatccttggagctggatctgaaaaaaatacggttgaaagtcgtgcaggtgattacaatgtgtaggcaaaccagaaaaccatggctttaaccagcagcttttgttagaaatgatttctccaatgaatgtagaaacgtttgctgctgaattgtgacctttccattttacctgcttttcctgcaaagtatattttgcagacccaggcagtgctgctcgctctgttcctggttcacccagtgccgtgtgtgctcagtgcatcctgtgcacgggtcactgtgtgccctggcctgggtgagcatcattcttcggggagaaccttgatgaaaacaaagctgcattccaaaaagttaaaaccgtgctacttactgtactgaggtaaaaattaaaagacctaggggactcttccaaaagttaaaacgtaaataaatatcttgtaacattaatatacacctgacgatgtcctgagtgaacacgccccactttaaaacaaaacaaaacattactattattctaaaatattaatttaggattgttatgcaaatatgtactatttaaatatttattgatgaataacatgcatacagcaatataggaacaaaatatttatggaatgcttgatgaattattactaaataaatacacttgtgtatgtaagaatcagatttgctcatgcccttgacactttctccttcccaaaggtaaccaagaccttaagagctaagtgtagataaactttgtcattttctacacgtgttttattacagaacattaaaaacgtatacataatacaaaaaaaagataacagaccagtcacccagatttaacagctactagtcatgtgtcatttttgtttcacctatacttccagccattcccaccccaatttcattattttttagcctttttggataaaatgtatattcattgcaaggtacaatgtgaactgtaaatagtagagagatggggtttcaccatgttgaccaggctagtcttgaactcctgtcctcaggtgatccacctgcttcggcttcccaaattgctgggattacaggcataagccaatatactcagcctgagaattcatacttctaagaaagtacaaatccatagggcacatgagaactgcaatgtctatctacagtaaatacagtttgatgaataaaatgaaaggcaattgacctaaggtgaaaaaaaaa

SEQ ID NO: 465776 - DNA, 2529 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatggtaacttcttagaccaagtctagaaacaatctgaggacaataacaattccattctaaaaagaatctcccaacatttcttctgtctcaacctcaactgcatctgcctgtgaacttccagcttaccaaggctctatatcttctggcagtgacaaaggctccttccatgattggtatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaatagggcaagaaagctttctaagaccccgaactccagatatgcgatggggcaaatcctgaagcgtacatggctatctctcacagctaaagcatccctcacccctatccagcgcttcttacccctggcgcaagagaatcacctgcggggaggaaaactttcaaaatcccttaaacccaagttgtaaccgcacaactaaatcagaatccttggagctggatctgaaaaaaatacggttgaaagtcgtgcaggtgattacaatgtgtaggcaaaccagagaaacgtttgctgctgaattgtgacctttccattttacctgcttttcctgcaaagtatattttgcagacccaggcagtgctgctcgctctgttcctggttcacccagtgccgtgtgtgctcagtgcatcctgtgcacgggtcactgtgtgccctggcctgggtgagcatcattcttcggggagaaccttgatgaaaacaaagctgcattccaaaaagttaaaaccgtgctacttactgtactgaggtaaaaattaaaagacctaggggactcttccaaaagttaaaacgtaaataaatatcttgtaacattaatatacacctgacgatgtcctgagtgaacacgccccactttaaaacaaaacaaaacattactattattctaaaatattaatttaggattgttatgcaaatatgtactatttaaatatttattgatgaataacatgcatacagcaatataggaacaaaatatttatggaatgcttgatgaattattactaaataaatacacttgtgtatgtaagaatcagatttgctcatgcccttgacactttctccttcccaaaggtaaccaagaccttaagagctaagtgtagataaactttgtcattttctacacgtgttttattacagaacattaaaaacgtatacataatacaaaaaaaagataacagaccagtcacccagatttaacagctactagtcatgtgtcatttttgtttcacctatacttccagccattcccaccccaatttcattattttttagcctttttggataaaatgtatattcattgcaaggtacaatgtgaactgtaaatagtagagagatggggtttcaccatgttgaccaggctagtcttgaactcctgtcctcaggtgatccacctgcttcggcttcccaaattgctgggattacaggcataagccaatatactcagcctgagaattcatacttctaagaaagtacaaatccatagggcacatgagaactgcaatgtctatctacagtaaatacagtttgatgaataaaatgaaaggcaattgacctaaggtgaaaaaaaaa

SEQ ID NO: 465777 - DNA, 1973 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatggtaacttcttagaccaagtctagaaacaatctgaggacaataacaattccattctaaaaagaatctcccaacatttcttctgtctcaacctcaactgcatctgcctgtgaacttccagcttaccaaggctctatatcttctggcagtgacaaaggctccttccatgattggtgtgagtaggcttggacacctgcagggcagacacccaggaataatcaactgagccttcagtggtcctcttttgctgggtcaagatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaatagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaataatgtaaaataagaagaaatgtataagctgaatctgcaaaaacatgtgttgctgaagagatccactgtacaatgtgacaaatcacttcatacaccgtcttgaatacacataatgcacagttgcacctcttagtgaaatctctggtgatatggctgtctgctgctcgtatcatgatcctgagagaaacgaatgcttcttgcatcaccaatatgacatcctaaatctccaccgagtggttagaccagacgttgatgtgatgaacactgctttacatgacagttaagacacatgatagattaactacttatctgaaatcggcagaagacattcttacttttatgcataggcactcaaattgtttgctaaaggtctaaaggtgacaatactgaacgtttaacaaccgttgataaaaacgtctacagggtagca

SEQ ID NO: 465778 - DNA, 1610 bp, Homo sapiens
  misc_feature (1200)..(1200): n is a, c, g, or t
  misc_feature (1202)..(1202): n is a, c, g, or t
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaatagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgnanaaaaaaagaaaaaaaaaaaaaaaatgttgtgggggcgcccgggccccgggaaaaaagtttttaaaacccactcgcggtggggggcgggggcccccaaggtgttatgggaaacctgggccaacgcgggtcccaagaaaaaaccggggccgaaactaggtggcggggttctccccaataaaaaagcccggggaccggggggtttgaaacgccaaaggcgttcgggccttacgggctttacaccaggggtcaaggaccataaccgccccgggcagggtcaagataacacataatatacagaacaaaaacccctagtaacaacacgaccacagacgcaagaaccacagacagaaccgtactaggacacacggcaacaaaaatcacataaccaacctcagaccacgaccgaat

SEQ ID NO: 465779 - DNA, 1505 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatggtgagtatacggggttcggcatcccgagaggggagagcaggctgtgaaaccggcaggaccggcccccacggttagctccgagtctcccgcagcttggccctcagtcccctgtggctgcaagatggccgctgggccagcatcgaggacccccacatccggcctggcccatccggtgctgtccctgggcagcgccctgctctgcgcccacagccatgagtatttcccagattgttcagggaggcctggtgggtcatcagggaaaaactgccactgggtgtttgcgtgggaggagctgcggcccgtggggtccccagtctctcttgttaaaaattaacgggagtctatgttaaaacgttaaccagtttatctgaacaaacagtgattggtgaaatggaaagcacccagccatgatttctggtccaccagaggggcataaaggaaaggctttcataagatgcatgagaaagcagcccaaattcaaaaattggttccagttatgtagtcaccttatttgaactatccagatggaaatgtcctggttacatattcagaggttaattgcatgtttgccattggttaaacgtgcattttgtttcaggctaagataatgctttataggaaatgtatttgagttaggttttagtttttgtt

SEQ ID NO: 465780 - DNA, 370 bp, Homo sapiens
cgttgctgcaaaggaggttttttttgtttgtttttgctaagtagtattgctgtacatgtgacactttttaaattcaatttaccatcaataggctggacatggtggctgatgcctgtaatcccagtgctgtgggaggccaaggcgggtggatcatgaggtcaggagatcgagaccatcctggacaacgtaatgaaaccccgtctgtactggaaatacaaaagttagccaggcttggtggcatgcgcctatagtcccagctactcgggtggctgaggaaggaggattgcttgaacctgggaagtggagattgtagtgagttgagatcgtgccactgcactccagcctgggcaacagagtgagacgtcatctc

SEQ ID NO: 465781 - DNA, 2217 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatttcttccagaccatggctggagaaggaaagaaggtgtgttttgcctgattcagggactatagagagaaccaagttctgcaggcctgtcacctaagtctcagatgagtatgaattcttttgtgtttttcacagatttttgcagtggcaggaccaagttcaaatgagtcatagccaagtctacagtaagatgtggtagtattctgttttgaaccgaggaccatgattggcaagcttgccacttggtcaagtgcttaccctctaaagatgtcttccttggtctttgcctccagctgggtgtcacaaactctgaactggattctaaggctttcatgaatgcacttatgtttcctgtggcagctgcattatgttgtgggggatgtgcatgccgaacctcccattctgtcgtcttgcttatgttactctcctttatgtttcactttctcaaatgaatgtcaagctggtgatttttagattcaaaaattctaaaataaattgctcaaatttccacattatgtaagctattaataaaatgtcttgtaggtgctacatattcattaaaatttttggttgtaattttaagctcactgcaggcagaaaggaatcattaacatttatattcttttttttagtctgtatctaaatgatggtatattttaattccagatatttactttatactgcagtaatgctcgtcatattttgcaaaatttatgttgttcttttatttggaaatataaggcttttttagctcctgaaatctatattatagtcatataattttattatgttttgtggtaagaagtgcagcaacatattgagaacataataaaattatcctgtatttttaatgattatttattaaattcctctcattagagcctgttattaatgattgtaatgtattttctgtataattttactgcaatttattaaattctaatgacttaaattgtctgcttttcatgagtgcacacagttgaatgctgtagatatctaaagaattatttttcggccggttgtggtggctcatgcctgtattcccagcaccttgggaggccaaggcgggtggatcacgaggtcaggagatcgagacaaccctgactaacatggtgaaaccccgtctctactaaatatacaaaaaattaaccgggcatagtggcaggcgcctgtatccccagctactcaggaggctgaggcaggagaatggcgtgaactcagtggacagagtttgcagtgagccgagatcgcgccactgcactccagcctgggcaacagggcaagactctgtctcaaaaaaaaaataaaaaaaaaaacggttattttccattgtaaatctatgttgtattcaggattttatgcac

SEQ ID NO: 465782 - DNA, 3442 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaataatgtaaaataagaagaaatgtataagctgaatctgcaaaaacatgtgttgctgaagagatccactgtacaatgtgacaaatcacttcatacaccgtcttgaatacacataatgcacagttgcacctcttagtgaaatctctggtgatatggctgtctgctgctcgtatcatgatcctgagagaaacgaatgcttcttgcatcaccaatatgacatcctaaatctccaccgagtggttagaccagacgttgatgtgatgaacactgctttacatgacagttaagacacatgatagattaactacttatctgaaatcggcagaagacattcttacttttatgcataggcactcaaattgtttgctaaaggtctaaaggtgacaatactgaacgtttaacaaccgttgataaaaacgtctacagggtagca

SEQ ID NO: 465783 - DNA, 3380 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatggctgaatgctatcccagtgaatatacgtgccctgtttgttgaatctactcatccttaaaggctggacatggtggctgatgcctgtaatcccagtgctgtgggaggccaaggcgggtggatcatgaggtcaggagatcgagaccatcctggacaacatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgatttgcaaatacaaacaaaacttacattatttcttgtagctgcatattgaaaaaagagaaatgaagctcaaccagtcagaagtagccaacaaccttatataaatagaaactgtccaacaaggtaaacagacaaacaaaaaacaataaaaaaagttgtgctaccaccaaatgatttctttgtttctacatttttcaaataaatacttgcttcttacactgtcaatgaagcactcaatatctttccgtctgatattttataatttatcaattgctcttactcaaataaacactttgcaatttcaaaaaaaaaagaagacacaacagaaaaaacgacgaaacacaacacaagacagaacagagaagagaaagacagaaaacactgggggcggtccaccagaaagaatagtaaaaccagcagggaggcgccaccgaaatggccggaacgccagaagaggcgaaaggggaatcacaaaaaagcggcgacgcgcgaaaacacaagggggccacgataagagggcaaaa

SEQ ID NO: 465784 - DNA, 2412 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaatagggcaagaaagctttctaagaccccgaactccagatatgcgatggggcaaatcctgaagcgtacatggctatctctcacagctaaagcatccctcacccctatccagcgcttcttacccctggcgcaagagaatcacctgcggggaggaaaactttcaaaatcccttaaacccaagttgtaaccgcacaactaaatcagaatccttggagctggatctgaaaaaaatacggttgaaagtcgtgcaggtgattacaatgtgtaggcaaaccagaaaaccatggctttaaccagcagcttttgttagaaatgatttctccaatgaatgtagaaacgtttgctgctgaattgtgacctttccattttacctgcttttcctgcaaagtatattttgcagacccaggcagtgctgctcgctctgttcctggttcacccagtgccgtgtgtgctcagtgcatcctgtgcacgggtcactgtgtgccctggcctgggtgagcatcattcttcggggagaaccttgatgaaaacaaagctgcattccaaaaagttaaaaccgtgctacttactgtactgaggtaaaaattaaaagacctaggggactcttccaaaagttaaaacgtaaataaatatcttgtaacattaatatacacctgacgatgtcctgagtgaacacgccccactttaaaacaaaacaaaacattactattattctaaaatattaatttaggattgttatgcaaatatgtactatttaaatatttattgatgaataacatgcatacagcaatataggaacaaaatatttatggaatgcttgatgaattattactaaataaatacacttgtgtatgtaagaatcagatttgctcatgcccttgacactttctccttcccaaaggtaaccaagaccttaagagctaagtgtagataaactttgtcattttctacacgtgttttattacagaacattaaaaacgtatacataatacaaaaaaaagataacagaccagtcacccagatttaacagctactagtcatgtgtcatttttgtttcacctatacttccagccattcccaccccaatttcattattttttagcctttttggataaaatgtatattcattgcaaggtacaatgtgaactgtaaatagtagagagatggggtttcaccatgttgaccaggctagtcttgaactcctgtcctcaggtgatccacctgcttcggcttcccaaattgctgggattacaggcataagccaatatactcagcctgagaattcatacttctaagaaagtacaaatccatagggcacatgagaactgcaatgtctatctacagtaaatacagtttgatgaataaaatgaaaggcaattgacctaaggtgaaaaaaaaa

SEQ ID NO: 465785 - DNA, 2537 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatggtaacttcttagaccaagtctagaaacaatctgaggacaataacaattccattctaaaaagaatctcccaacatttcttctgtctcaacctcaactgcatctgcctgtgaacttccagcttaccaaggctctatatcttctggcagtgacaaaggctccttccatgattggtatatgtattcatttcctaccaccgtagtggaagagatactatccctatctttacaactgatagcatttccaacagtaagctgtgagattctgcttgaaatcacctctcaaacaaataaggcaagaaagctttctaagaccccgaactccagatatgcgatggggcaaatcctgaagcgtacatggctatctctcacagctaaagcatccctcacccctatccagcgcttcttacccctggcgcaagagaatcacctgcggggaggaaaactttcaaaatcccttaaacccaagttgtaaccgcacaactaaatcagaatccttggagctggatctgaaaaaaatacggttgaaagtcgtgcaggtgattacaatgtgtaggcaaaccagaaaaccatggctttaaccagcagcttttgttagaaatgatttctccaatgaatgtagaaacgtttgctgctgaattgtgacctttccattttacctgcttttcctgcaaagtatattttgcagacccaggcagtgctgctcgctctgttcctggttcacccagtgccgtgtgtgctcagtgcatcctgtgcacgggtcactgtgtgccctggcctgggtgagcatcattcttcggggagaaccttgatgaaaacaaagctgcattccaaaaagttaaaaccgtgctacttactgtactgaggtaaaaattaaaagacctaggggactcttccaaaagttaaaacgtaaataaatatcttgtaacattaatatacacctgacgatgtcctgagtgaacacgccccactttaaaacaaaacaaaacattactattattctaaaatattaatttaggattgttatgcaaatatgtactatttaaatatttattgatgaataacatgcatacagcaatataggaacaaaatatttatggaatgcttgatgaattattactaaataaatacacttgtgtatgtaagaatcagatttgctcatgcccttgacactttctccttcccaaaggtaaccaagaccttaagagctaagtgtagataaactttgtcattttctacacgtgttttattacagaacattaaaaacgtatacataatacaaaaaaaagataacagaccagtcacccagatttaacagctactagtcatgtgtcatttttgtttcacctatacttccagccattcccaccccaatttcattattttttagcctttttggataaaatgtatattcattgcaaggtacaatgtgaactgtaaatagtagagagatggggtttcaccatgttgaccaggctagtcttgaactcctgtcctcaggtgatccacctgcttcggcttcccaaattgctgggattacaggcataagccaatatactcagcctgagaattcatacttctaagaaagtacaaatccatagggcacatgagaactgcaatgtctatctacagtaaatacagtttgatgaataaaatgaaaggcaattgacctaaggtgaaaaaaaaa

SEQ ID NO: 465786 - DNA, 2083 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatttttgcagtggcaggaccaagttcaaatgagtcatagccaagtctacagtaagatgtggtagtattctgttttgaaccgaggaccatgattggcaagcttgccacttggtcaagtgcttaccctctaaagatgtcttccttggtctttgcctccagctgggtgtcacaaactctgaactggattctaaggctttcatgaatgcacttatgtttcctgtggcagctgcattatgttgtgggggatgtgcatgccgaacctcccattctgtcgtcttgcttatgttactctcctttatgtttcactttctcaaatgaatgtcaagctggtgatttttagattcaaaaattctaaaataaattgctcaaatttccacattatgtaagctattaataaaatgtcttgtaggtgctacatattcattaaaatttttggttgtaattttaagctcactgcaggcagaaaggaatcattaacatttatattcttttttttagtctgtatctaaatgatggtatattttaattccagatatttactttatactgcagtaatgctcgtcatattttgcaaaatttatgttgttcttttatttggaaatataaggcttttttagctcctgaaatctatattatagtcatataattttattatgttttgtggtaagaagtgcagcaacatattgagaacataataaaattatcctgtatttttaatgattatttattaaattcctctcattagagcctgttattaatgattgtaatgtattttctgtataattttactgcaatttattaaattctaatgacttaaattgtctgcttttcatgagtgcacacagttgaatgctgtagatatctaaagaattatttttcggccggttgtggtggctcatgcctgtattcccagcaccttgggaggccaaggcgggtggatcacgaggtcaggagatcgagacaaccctgactaacatggtgaaaccccgtctctactaaatatacaaaaaattaaccgggcatagtggcaggcgcctgtatccccagctactcaggaggctgaggcaggagaatggcgtgaactcagtggacagagtttgcagtgagccgagatcgcgccactgcactccagcctgggcaacagggcaagactctgtctcaaaaaaaaaataaaaaaaaaaacggttattttccattgtaaatctatgttgtattcaggattttatgcac

SEQ ID NO: 465787 - DNA, 1160 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaataggtttttgcactgcctcactaggttgggtttctttatcctttgaaatattttctctcccttcaccaatctgaggacattttttcctcaatatcagcatccagttgcctggcctgcaatgtgtctctaaggaatggaaactaa

SEQ ID NO: 465788 - DNA, 1685 bp, Homo sapiens
atatccacccccattacagtgaggggcacagggcactagacctgttctagaggtccttcagagaagagagaggcctagagatgtgggcagatgaggacttggaataaagcagaatgtgacaatgcactgggctctggagtgtggggcccagaaaaaatactagatttttgggctgtccttgaggtcctcattcagaagtggaagaaaataatgtctctgaatgctgtcacggttggtggaataaaaagttgtgagttgcggaccaagtacgtctactcagatgtgaatcccaaggccttaagctgtcctcgggtttcctcattggctgggggtctatgcagatactcctatgttcctgatctaggaaacagaatttctaatgcagatgtcacctggtgggcagaagtggtgccctcacatctctttgtaatgttctataatgggggtcacttcccagagtggtttagcctttcaatggctattatttctgatcaaaatggaataaaactagaaatgaataacagaagaaaacaaaaatagcaacatatatatggaaattaaacaactcacttttgagcatgctcatgtttaagggtttcattgacactgatgtgggaacagcccaatcaggcgcgcagttggagaggacaggagaggagggcgtggcttctggcgtttggcgggtctttgtctctcgctggcgctggcacaggaacttgggatccgtctcctctttcgcctcctccaccttgggagccccgggctactctttcacagcccctgttgccctgtgatctgtaggtccttggggacgcacagttaaggtgccaggacatcctggaagctgggaaatgtagagacgtggtttccccatgttggctaggatggtcttgatctcctgaccttgtgattcacttgcctcagcctcccaaagtgctgggattacaggtgtgagccaccacacccggccttgagtttatgtttttattggtgcaagatatgtattcatttcctaccaccgtagtggaagagatactatccctatctttacaactgatagcatttccaacagtaagctgtgagattctgcttgaaatcacctctcaaacaaataaaaaacagacctgggagacatgctacactcattctgctgaagaaatagggcaagaaagctttctaagaccccgaactccagatatgcgatggggcaaatcctgaagcgtacatggctatctctcacagctaaagcatccctcacccctatccagcgcttcttacccctggcgcaagagaatcacctgcggggaggaaaactttcaaaatcccttaaacccaagttgtaaccgcacaactaaatcagaatccttggagctggatctgaaaaaaatacggttgaaagtcgtgcaggtgattacaatgtgtaggcaaaccagaaaaccatggctttaaccagcagcttttgttagaaatgattctccatgatgtgaacgttgtgtgaatgtgacttcctttactgtttccgcagttttgcgacggggtggcgtctgtcgttaccgcggggccgctcggccggacgggccgggggggaatgggacggaaaggtccaaaaggctggcggggaaaaaggggcgtgaaaactgggggggggtcggggtgtgctcactcatagctcgggtaatttttga

SEQ ID NO: 465789 - DNA, 3609 bp, Homo sapiens
ggcagggtgatgttgtggggccttgagcttggggctccccagagggcaagagcctgagacagcaggtcaataaaaggtgagtggtcgacgggattggcagatcctggactcagcccttcactgggcaaatgtcaggcccagtggctgggcagcttgggggcatttccacctgaatgcagggacaagaccaccggccagtggcatcagactggcaagaaggcaagttccagccgataggagaggaaagagtgcaaggacacccaaggacacctgaaaggctggcaacagtggtggttgccttcggcccccagctccttggctgtcaccgctctgcctgtggaagcccgtccccagcccacacgggcctctacaggagccctcaaggacgctccgagtggctgtgctcctccggtctctcctggtgcttctcctggctgtgcctcctgccagaggcaaccagccacacccaggccacgttgccaccctctgcacagcccaccctcaccctttccagaagtagccagtccattctcgcaaccttcctagaggaagtcaagttgcttaccaacttccaccatggcaagcttacgatgcagcttgccctggcctgcacttcgccttgctgccatcatgtgaagaaggacgtgtttacttcccctcctgccatgattcagcgtgagaatggactaatacgctgagggccacagggttcctaagagccgcaaggaagggaacaagtcccactgtgaaagcgcttattttttaatagactttgttttttagagcagttttaggttcacagcaacactgagtggaaagttcagagattcctcatatgttccctgtccccacccccaactattcacatcccccaccagagtggtacatttgttataatcaattaacctatgttgacacatcattatgacccaaactccattgtctacactagggtccactcttggtgttgttcattctatgggtttggacaaatgtataatgtcacatatccaccattgtggtgtcatataggatagtttcactaacctaaaaataaaaatcctctgtgctccacctgatcattcctccttcccccaaacccctggtaactactaatcttttactgtctccatagttctaccttttccagaatgtcatatagttggaatcatagagtaagcagccttttcagatcaacttctttcaattaagaaagtttgtttcctctgtgtcttttcatggcttgatagctcatcgtttttttaagtcctgaaaaataacccattgtctggatgcactatagttatgcatttatctgggcagtcccagatatcctggttgcttccaggttgtatcaattcataaatacagatgctatagacatttgtgcatgaatttttgtgtggacatgagttttcaacttctttgggtaaataccaagaaggaagagaggggacaagctccagtgtgtaagcacttttcaaacctctgcttgcatcacttttgctaatggccaaaacaagtcatgtggtcaagtccagattaggaacagggagatggtggagagaaatagctctacctcctaatggaagaagaggcaaagtcatattgcaaagacttgtgcccactggaaagggaagaatctgtggtcgtttttgcaatcgatcccattctggtacatgcttgctttttgaagtcttgatgttctgcttaaagcatcaagttgttacatcatggcccatttgcgatataaagaataaaacaaagctattggactagatggcttcagaaactgcttagttcaaaagatcagtgcttctcagactttaatgtatgtatgaatcacctggagagcttgttaaaatgcagatcagattcagcaggtctgggctgggacccgagatgctgcatttctaataagttccctggtgatgctgctgctgctgctccttggaccaccctttacacagcaagaacctggaggtgggatctgcagattcagaatctgcattttgacagactcccaagtaattcgtgagctcagtacagtttgagaagcaccagcccaggccagcagttctcaatcttccatacatttgaatcaccaggggagctttacaaggtgctgatgcctgggtggcatctccaagaatttctgatctaattggtctggggtaaggccaaggattcaggacttttacagctgcctaggtgcctttccactttaagaacctgagatcctgttcctctggtggaaaaaccagcctccccaggacctgtcccacaccccagccaacaggacatttcatgtctgttgcagatgctcttgctgcctcttcccattccctcagcatgctggctgaacttcccacagccagcacctgtgagtcttcactcgaggcttctctcttgggctgcactgtccaaatacaggtgagttggacatgctggggaattaacgcccctcaggagcagccctctgtcatgatgacaggagtcggtgggcaagtgttgcagctcccggggtgggataactccgagccatgtgctctacgctggccccagagcccccagcacaacggcgttccaattgcccacagcggtaagggtttgatgacaccctgtttggctgcctgctctgctttccttcccacgtcctaattgatgtttcctgggatctccctccaaatcaactatcagcactgaaatccttgtcttagagtctgcttctatgggaatccaaacaaagatagtatccagctaagtcactttttgttcatgatctttggtatggggtagtgtaagggacagacccctaggcggggtgctgggggaacccttgcttttcacttgtgaccttgggaccaggtaacaggaatgaagaggtagggctgagacctgacctgcttttagggggagctgtggggcaagactgtagatgctctggtcatgacttcccctctcggtcaggccctcttctgccaggctggcctcagacactggggcccttgcaggcagccacaaagcagatgccgtcgttgatggagcatgtctcagagcagctgatggggcacacctctgcacctggcagccagcctcctgcatggccttctccaccgtctccttctctgggtggagcccaaagaacttcttggagcctaccatatagtgggagtgcagggcagccatggtgaccaggttcccatctgctttcagcaggctggccagcctctgcagggctgcccagtacatgtccacatcaggacaggcactcttcaggggacacctggattgaccccagtggatgcagcttggtcatatcgcacttcagcaaccacgtgactgtccagcaaagctggttctccttctcatgccacctgcttctatggaggagggtcacagagatgacataatgattgtgatagcagcccctcagccctcaccaccaccctctgggcaaagcctgtgacttatcctgttcagcaactctttgagcgagattattattttcctcattatacagatgaagaaactgaggcatagacttgctcacgtctacacagctgtaggtgacagtggattcgataactccccttcccctcctcctgc

SEQ ID NO: 465790 - DNA, 848 bp, Homo sapiens
gcacattcacacataagtcaggctacctgaaaaaggcatctccatgaaaccttccagtggagcagcacagacaggcatggcctttggccctgttcctccccacacagcctcagaggcatgcaaagaggtgagcgaggggaggacgaggcagactcaggtggaggggaaaggaaatctcagccgtactccccaggtgccatctactcggagaccctcagaagccctccaaaccgttccatcagaccgagcctcacatttcaggttgggactaaatggctctcctacccacacttcagttgttcttgaagcggggaagaaagggaaatgcgctgacacggagggacgcggcggcggccttgcccttgaaagcccgcgttaccgggcgcgggactcagctggcgtcagggcgctggaaatggactcccgcgcgctcgcccccgctctgccggaggacccagcccgggctaattggcgctgtgaatgattcggggctgtgaacaggcgactgcaatcagactagggctgatggcgttgggagtcttgcagagtttgcactggcaaggcaggctttttaaacccttcactgctccactggaaacaccaccaaactaaggcctttgggataaaatgccagacaagacacagtcgtcgccttcaaggggatttaagtctagcaggagtgggagaagttgaaaagaacacaaggaacactgttgactcccactgtataagaactacagtgcatctatctccattagcattgtcacacgggttttataaaatcatattacaaaatgtgggtcagtgatcactgagtcatgtaatttatcaagacaatacccagatgc

SEQ ID NO: 465791 - DNA, 410 bp, Homo sapiens
gcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggtaaggtatatgtatattttattgttagaatgttgttcaaggaataaagtcataaattttaatacatcttaatatttttgttattaacctgtttctatactttattgagtaccagaactacatgatgacccagttgtttaaaaattgtaatgttttttaaccatgtagatcagatatctgctcactggaaattactatttgaataggtaactagagagtctttaatgaataatgtataagaaaatactcactaaagag

SEQ ID NO: 465792 - DNA, 409 bp, Homo sapiens
tcagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggtatatatgtgacatgaatttttacaaatattaattggtcacagatttgcatacatcctttccatgagcattattacaagaagaatatttagaatttttctgagccagtataagtatttaaatcaatctttatcaataaaattcaaaacctttgaaagataaattga

SEQ ID NO: 465793 - DNA, 2290 bp, Homo sapiens
agttcccctgctgacccgagggcgcgggcggtcccggcaggccccgcgacgcagccaacggccgggacgtgcgcgcatgcgcgctaggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgatgaatcagtgaataaaatgaatataggaaatgaatataaaattattggaattccaacctgtgtaaaaacctcacaaactgctgtctgtatagaagcaaatagcataactttttgtaattcaaaagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtaggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggtaatgaattaaattattaatgatcactacaaataacttttatttaaccttaaatattcttagttggttaaattaaaatgttacatatatttttaaaatattattttaaagaataacaaatctctaccaggtttattgaagattatcaatttgctttatctttacatgcttctcctagtctatgtttaagaccacatttcattaagtctaagacacattattttatgtgctgtaaagaaaaaattctgccaattttaccatgccatgccatcaattgttaagatacaactggagtacggtaataagatgaaaatatatgtctttgaattgaagaattatagtattattatatt

SEQ ID NO: 465794 - DNA, 3008 bp, Homo sapiens
ttggaagccatgtgttaacactgagtgatcctcctcagccaagtccctaatgcatggaaaagaacctcctgacccagtccccaaaggctggacttttcctttgcaagaaataaggagggtaaagttcaccataaataacaaagtcatggagtcaagctgtcacaattggccaccgttcctaaggcatttgaattgtatgcattgacaggaaaaagcaggaaggagtgaagacagaacaagggaagagaagacgcatttgctgagatctattatatgccaattggaggactacagatttcacaattcacatctgttgtcttatttctttctcataatcccaaagataattctaaagttacacattatcatctccatttacaattaagaactgatgctccaagaagaaagatctcacagtgtgtaggcaacagacctaagattcaaacctatattggtgggtgttaatgtccttgttctttctgataaggaacaacactgggatccagtccagggctgagaggcagtgggacaggaccacactgggatccagtccggggctgagagtcagtgggaaaggaccacactgggatccagtccagggctgggagtcagtgagaaagcatacgccaggatccactccagctgggagtcagtgggaaaggaccacgctgggatccagtccagctgggagtcatgggaaaggatacactgggatccagtccagctgggagtcagtgagaaaggcccacactgggatccagtccagggctgggagtcagtgggaaagaaccacgctgggatccagtccaaggctgggagtcagtgggaaacgaccacaccgggatccagtatggggctgggagtcagtgagaaaggacctcaccgggatccagtctggggctgggagtcagaccacaccgggatccagtccggggctgggagtcagtggaaaaggacgacactgggatccagtccgaggctgggagtcagtgggaaaggacacgctggcatccagtccggggctgagagtcagtgggaaaggacgacactgggatgcagtccggggctgggagtcagtgggaaaggatgacactgggatccagtccagggctgggagtcatcagtgggaaaggaccacgctgggatccagtccggggctgagagtcagtgggaaaggacgacactgggatgcagtccggggctgggagtcagtgggaaaggacacactgaaatccagtccggggctgggagtcagtgagaaaggaccatgctgggatccagtccggggctgggagtcagtgggaaaagaccacactgggatccagtccggggctgagagtcagtgggaaaggaccacactgggatccagtacggggcttggagtcagtgagaaaggaccacactgggatccagtccggggctgggagtcagtgggaaaggagcatgctgggatccatctggggctgagagtcagtgggaaaggacacatcaggatccagtccggctgggagtcagtgggaaaggacacgccggcatccagtccggggctgagagtcagtgggaaaggacacactgggatccagtccggggctgggagtcagtgggaaaggacgacactgggatccagtccagggctgagagtcagtgggaaaggacacgccggcatccagtccggggctgggagtcagtgggaaaggaccacgctgggatccagtccggggctgagagtcagtgggaagggacacactgagatccagtccggggctgagagtcagtgggaaaggaccacgctgagatccagtcccgggctgggagtcagtgggaaaggcctacactgggatgcagtccggggctgggagtcagtgggaaaggaccacactgggatgcagtccagggctgggagtcagtggcaaaggacacactgggatccagtgagaagggacacaccaggatccagtctggctgggagtcaatgggaaaggaccacactgggatccagtccggagctgggagtcagtgagaaagaacaacactgggatccagtctggggatgggagtcagtggcaaaggacacactgggatccactccagggctgggagtcagtgagaaaggaccacactgggatgcagtccgggactgggagtcagtgggaaaggacacactgggatgcagtccggggctgggagtcagtgggaaaggaccacactgggatccagtccggggctgggagtcagtgagaaaggaccacactgggatgcagtccggggctgggagtcagtgggaaaggaccactctgggatccagtccggggctgggagtcagtgagaaaggaccacactgggatccagtccggggctgggagtcagtgggaaaggacacactgggatccagtccggggctgggagtcagtgggaaaggaccacactgggatccagtccggggctgggagtcagtgggaaaggacacactgggatgcagtccggggctgggagtcagtgggaaaggaccacactgggatgcagtccggggctgggagtcagtgggaaaggaccacactgggatccagtccggggctgggagtcagtgggaaaggacacactgggatgcagtccggggctgggagtcagtgggaaaggaccacaatgggatgcagtccagggctgggagtcagtgggaaaggaccacactgggatgcagtccggggctgggagtcagtgggaaaggaccactctgggatccagtccggggctgggagtcagtaagaaaggaccacactgggatccagtccggagctgggagtcagtgagaaacaacaacactgggaaccagtccggggatgggagtcagtggcaaaggacacactgggatccactccagggctgggagtcagtgagaaaggaccacactgggatccagtccggggctgggagtcagtgggaaaggacccccctgggatccagtccggggctgagagtcagtgggaaaggacgacactgggatccagtcc

SEQ ID NO: 465795 - DNA, 3085 bp, Homo sapiens
ttggaagccatgtgttaacactgagtgatcctcctcagccaagtccctaatgcatggaaaagaacctcctgacccagtccccaaaggctggacttttcctttgcaagaaataaggagggtaaagttcaccataaataacaaagtcatggagtcaagctgtcacaattggccaccgttcctaaggcatttgaattgtatgcattgacaggaaaaagcaggaaggagtgaagacagaacaaggggagaatgtaacctgagttggaaggtgtaatatttaaatgtatttgcaaacctgttttgggccaaaaggggtaggaggaagagaagacgcatttgctgagatctattatatgccaattggaggactacagatttcacaattcacatctgttgtcttatttctttctcataatcccaaagataattctaaagttacacattatcatctccatttacaattaagaactgatgctccaagaagaaagatctcacagtgtgtaggcaacagacctaagattcaaacctatattggtgggtgttaatgtccttgttctttctgataaggaacaacactgggatccagtccagggctgagaggcagtgggacaggaccacactgggatccagtccggggctgagagtcagtgggaaaggaccacactgggatccagtccagggctgggagtcagtgagaaagcatacgccaggatccactccagctgggagtcagtgggaaaggaccacgctgggatccagtccagctgggagtcatgggaaaggatacactgggatccagtccagctgggagtcagtgagaaaggcccacactgggatccagtccagggctgggagtcagtgggaaagaaccacgctgggatccagtccaaggctgggagtcagtgggaaacgaccacaccgggatccagtatggggctgggagtcagtgagaaaggacctcaccgggatccagtctggggctgggagtcagaccacaccgggatccagtccggggctgggagtcagtggaaaaggacgacactgggatccagtccgaggctgggagtcagtgggaaaggacacgctggcatccagtccggggctgagagtcagtgggaaaggacgacactgggatgcagtccggggctgggagtcagtgggaaaggatgacactgggatccagtccagggctgggagtcatcagtgggaaaggaccacgctgggatccagtccggggctgagagtcagtgggaaaggacgacactgggatgcagtccggggctgggagtcagtgggaaaggacacactgaaatccagtccggggctgggagtcagtgagaaaggaccatgctgggatccagtccggggctgggagtcagtgggaaaagaccacactgggatccagtccggggctgagagtcagtgggaaaggaccacactgggatccagtacggggcttggagtcagtgagaaaggaccacactgggatccagtccggggctgggagtcagtgggaaaggagcatgctgggatccatctggggctgagagtcagtgggaaaggacacatcaggatccagtccggctgggagtcagtgggaaaggacacgccggcatccagtccggggctgagagtcagtgggaaaggacacactgggatccagtccggggctgggagtcagtgggaaaggacgacactgggatccagtccagggctgagagtcagtgggaaaggacacgccggcatccagtccggggctgggagtcagtgggaaaggaccacgctgggatccagtccggggctgagagtcagtgggaagggacacactgagatccagtccggggctgagagtcagtgggaaaggaccacgctgagatccagtcccgggctgggagtcagtgggaaaggcctacactgggatgcagtccggggctgggagtcagtgggaaaggaccacactgggatgcagtccagggctgggagtcagtggcaaaggacacactgggatccagtgagaagggacacaccaggatccagtctggctgggagtcaatgggaaaggaccacactgggatccagtccggagctgggagtcagtgagaaagaacaacactgggatccagtctggggatgggagtcagtggcaaaggacacactgggatccactccagggctgggagtcagtgagaaaggaccacactgggatgcagtccgggactgggagtcagtgggaaaggacacactgggatgcagtccggggctgggagtcagtgggaaaggaccacactgggatccagtccggggctgggagtcagtgagaaaggaccacactgggatgcagtccggggctgggagtcagtgggaaaggaccactctgggatccagtccggggctgggagtcagtgagaaaggaccacactgggatccagtccggggctgggagtcagtgggaaaggacacactgggatccagtccggggctgggagtcagtgggaaaggaccacactgggatccagtccggggctgggagtcagtgggaaaggacacactgggatgcagtccggggctgggagtcagtgggaaaggaccacactgggatgcagtccggggctgggagtcagtgggaaaggaccacactgggatccagtccggggctgggagtcagtgggaaaggacacactgggatgcagtccggggctgggagtcagtgggaaaggaccacaatgggatgcagtccagggctgggagtcagtgggaaaggaccacactgggatgcagtccggggctgggagtcagtgggaaaggaccactctgggatccagtccggggctgggagtcagtaagaaaggaccacactgggatccagtccggagctgggagtcagtgagaaacaacaacactgggaaccagtccggggatgggagtcagtggcaaaggacacactgggatccactccagggctgggagtcagtgagaaaggaccacactgggatccagtccggggctgggagtcagtgggaaaggacccccctgggatccagtccggggctgagagtcagtgggaaaggacgacactgggatccagtcc

SEQ ID NO: 465796 - DNA, 588 bp, Homo sapiens
gtgccctgcaggatgaagacacacaggctcatctctatagccttccatgaccacaaacatgaaagaaagactcctacaaaggaagactatccactctcctggactggaagtgtttgaagaaatcctcaggggatataacacccggggcacatatgccaatatgtcggcccgttttgaacaagcaccatgtaaaacttcctctggaacacacatggatttaaaaatcccttggagagaaatgtatcctgctaaggccaacccagctctcagcctggttctcatgttgaccctggaaggttcacccacctctgttgggtggagatggcgtcctgggagcctagaagactgtccaggcacagagcaagggcagctgtctttccagagcagggctggaatgtagaagtggacttttggccacgtggatgaggaattgaagcagtcagttctgatctagagatggaaggcgcctgctgaggacagcagggctgcttggcaccctgggtccctgaatggctctgtggagcactgcctgatggcccaccctggactgttgcctgagacagaaataaacttttatcttgtttcaaa

SEQ ID NO: 465797 - DNA, 2207 bp, Homo sapiens
  misc_feature (2)..(2): n is a, c, g, or t
  misc_feature (4)..(5): n is a, c, g, or t
  misc_feature (8)..(9): n is a, c, g, or t
  misc_feature (11)..(11): n is a, c, g, or t
  misc_feature (13)..(13): n is a, c, g, or t
  misc_feature (16)..(16): n is a, c, g, or t
  misc_feature (19)..(19): n is a, c, g, or t
tnannacnncntncanctncaggtgccagggtggacagagcaaatagctgccagtctgacagcagcgggttcctggaggagccgctggaaccgctgcccctccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttccaaggattgcagcttctccgaggaaggtaggctggaaagagtaagaggtggccctgggggaaaaggcacaggaacccagagccagattcctcatgaggaagaagaagacgatgacgacaacgacgacgacaatgggagttctgagcagatgttgaaactaagagcaattttaggatgcaaaacaaaggggatagctggtaagaactcagcaagtcatcagagtgccggcaaatggactgggcttggaggtgccaaagttctttctcattgttctcagtgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgggacccagttggctgccttcactccacccaccttggagaacagcaccaggatgtctccttcatcatcagcttgggcaaagttaggtccaacccctttgtcaaattgtcctgttggagaaaaggatgcagatgtcttcctctagatcagagcaggtttgttaaccttcatacaaaatataaaggcccagaacagatgtagcaaggaaatttcaattttccccaaggagaaggg

SEQ ID NO: 465798 - DNA, 4668 bp, Homo sapiens
  misc_feature (3)..(3): n is a, c, g, or t
  misc_feature (6)..(7): n is a, c, g, or t
ccncannagcatttggtgtggtcagtattttggattttcaccattctaatagagattcacggatccatccgggtggtccgggcaccactggcgcccctctgcggctattccccagttccattttctgaagccacaggtcagaagccgctgtacaacactttgccgaactccagaatcttgaaggagacgtaaggagcagccacctgccgcgcaggcgcaagcctttctttcggcacaaagaccgtgggaggaggggtcggcgcaagcgctcggtgtctctctgaaaagaacatcatactgcctcctggctgacggagcgcagcgcaacgcatgcgccttgaagacttatggaacttatttcacgctcagggcggcggtgacgtccttgccgtggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagaggtacagaaaggggccagggagggacacacagagaaggaggtgacagagaacagatttgacttcattgcacatcctctttaacgaaacttgacttgtgaccttgtgaacttgaggaagctttccttgattctcacttggggcaggattgctttgtaaccctagatattttccaccaaagactgagatgctcagagccaccatgcccagctcaaggctttgcacttgtctcttacagctctgtgacacccaggatgaagtttctcagactctggctggtggggtaacaaatggcttaggtgagtgtttcttcctttcatcctggaagacttcgcttccctgtgctgtgatgagtttgacagtagatttgcttttccgggtgcaggcaggcctctcctagcctgccctccctggggctcatctgcgggagcagtcagggaattgccatttcctcctcgacagctgtgctcatgacccatctgtgctgcggcattcctcattcacaaggcttctgactggaggatcctccttcaagggcagtgggaatcagggtcaggtccatggtgttaacagaatacacctccttggtgacttagcttggagtgtggaagaatcatctctgcttgaagctaccctcctgacttccgggatttttttttaatctgcaaggaggcctggcatcttttgtaaagctaagcgggttttggtaacctcagtcctgtactcattaatgcatttctcccttgagtttatgcatctttatgttgccttttctttccagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacacttgtcccgtctcctctttaggttttatcaagcgtcttgttccttggtgcgtccccacgcttccagcttctgcacactttggttctttctcttaaggccacaggagaatatggagagcctgaccgtgtgagctttaagctgcggcagctgctgctccatccaagtggccgctctcactgagctcccctggggaggactcattctttgaatggcctccctggttttagcagtgtgccattgctactgttttccattgcctgggctctgaggacctctttctctggaagttcccttacctgattaagaacacttctaaaataaatgcagccgtcttaaagccccctccctatgaatctcattaaataaccaggaatgattaatcacccaagaaaagactgaaaaagaagctacagccaggataccatacccagacagacttttcgtcttttcttctgagggaggttccaagagataacctgggagactgtatctgcataataagacaaccttagttcacagtgcagtaccacccctcaccttccatgacttgtccacaagctattgtttgtccttcagtcccattcagcatccaaagagaaccatttgcaaaccactgtcaggtatttgggtccattcatatacagccccccagctccctttccctagtgaagagagtatttaagtgccaaccattgggcctttctgtgtatgttcatattttttatatggcttccctgcttcatgcatgttaataaatttgttatgattttctcttgttaacctgtct

SEQ ID NO: 465799 - DNA, 452 bp, Homo sapiens
  misc_feature (7)..(7): n is a, c, g, or t
  misc_feature (116)..(117): n is a, c, g, or t
ggggggngggggggggggggtaaaaaaaaaataaaaaaaaaaaggggtgttcccccccacaaattttgggggaagcccaaacccccggggtaatttttttttttagaagaccccanntccccccccctaaggatgggggggtcttgggaaagggaacacccccggagaaggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465800 - DNA, 254 bp, Homo sapiens
gttgcttcgcactccacgacccaaatggctgttccagggcgctagtcaacctcgtgccgaattcggcacgagggtttggtcccaagcagtaaatctccaaaaaggcaattggaaccgactctaaagccattgtaggaccctcaagtgaaggaccctcatgtaaaagagagaccaggcattctgagagtttcttgtttaaataactatgtacacacccagcaggcctggtctctcttttacatgagcctcgtgcc

SEQ ID NO: 465801 - DNA, 2859 bp, Homo sapiens
ggagagggagtgctaaaaattaggctaggtacgaggctggtgttaaggacaccagggccaggcttgtgttcgcagccttgccgtggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465802 - DNA, 3327 bp, Homo sapiens
  misc_feature (6)..(6): n is a, c, g, or t
ggaacngaagccgggagggaacgagggcggaagcggaccagggccaggcttgtgttcgcagccttgccgtggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttaggtgagtgtttcttcctttcatcctggaagacttcgcttccctgtgctgtgatgagtttgacagtagatttgcttttccgggtgcaggcaggcctctcctagcctgccctccctggggctcatctgcgggagcagtcagggaattgccatttcctcctcgacagctgtgctcatgacccatctgtgctgcggcattcctcattcacaaggcttctgactggaggatcctccttcaagggcagtgggaatcagggtcaggtccatggtgttaacagaatacacctccttggtgacttagcttggagtgtggaagaatcatctctgcttgaagctaccctcctgacttccgggatttttttttaatctgcaaggaggcctggcatcttttgtaaagctaagcgggttttggtaacctcagtcctgtactcattaatgcatttctcccttgagtttatgcatctttatgttgccttttctttccagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465803 - DNA, 2791 bp, Homo sapiens
  misc_feature (6)..(6): n is a, c, g, or t
ggaacngaagccgggagggaacgagggcggaagcggaccagggccaggcttgtgttcgcagccttgccgtggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttatgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465804 - DNA, 2579 bp, Homo sapiens
aagcaggctggtactggcctgggagatttttgggcatatcgtcgacccacgctggtcgttctgcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465805 - DNA, 2696 bp, Homo sapiens
  misc_feature (22)..(22): n is a, c, g, or t
  misc_feature (74)..(74): n is a, c, g, or t
  misc_feature (86)..(86): n is a, c, g, or t
  misc_feature (92)..(92): n is a, c, g, or t
  misc_feature (110)..(110): n is a, c, g, or t
  misc_feature (137)..(137): n is a, c, g, or t
cattctgggcccaggccacaantttccccctttcataaggggtctggacatctcagggtcctgtagtgactggncctcttcccagncgagtncagaaccctcggaagaancctttcccccaccggcggacctcctgnctccatcagatgaagaggcagcgcccaccggccacaccagcccctccggactgtcacgactctgggccacttggggcgacctctttctctgaacactcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465806 - DNA, 2588 bp, Homo sapiens
atctgtccctttgtttccaggtgtaaagaagaagcccgccgggcatgccgagcaggaaagaagcagctggtttttaacgcctaccaggctggggtaggagcactcaaactctccatgaaggatgtcacagtggagaaggcagagagcctcgtggatcagatccaagaggtacagaaaggggccagggagggacacacagagaaggaggtgacagagaacagatttgacttcattgcacatcctctttaacgaaacttgacttgtgaccttgtgaacttgaggaagctttccttgattctcacttggggcaggattgctttgtaaccctagatattttccaccaaagactgagatgctcagagccaccatgcccagctcaaggctttgcacttgtctcttacagctctgtgacacccaggatgaagtttctcagactctggctggtggggtaacaaatggcttaggtgagtgtttcttcctttcatcctggaagacttcgcttccctgtgctgtgatgagtttgacagtagatttgcttttccgggtgcaggcaggcctctcctagcctgccctccctggggctcatctgcgggagcagtcagggaattgccatttcctcctcgacagctgtgctcatgacccatctgtgctgcggcattcctcattcacaaggcttctgactggaggatcctccttcaagggcagtgggaatcagggtcaggtccatggtgttaacagaatacacctccttggtgacttagcttggagtgtggaagaatcatctctgcttgaagctaccctcctgacttccgggatttttttttaatctgcaaggaggcctggcatcttttgtaaagctaagcgggttttggtaacctcagtcctgtactcattaatgcatttctcccttgagtttatgcatctttatgttgccttttctttccagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465807 - DNA, 361 bp, Homo sapiens
gtgagccaccacacctggcccaaggtgagtgtttcttcctttcatcctggaagacttcgcttccctgtgctgtgatgagtttgacagtagatttgcttttccgggtgcaggcaggcctctcctagcctgccctccctggggctcatctgcgggagcagtcagggaattgccatttcctcctcgacagctgtgctcatgacccatctgtgctgcggcattcctcattcacaaggcttctgactggaggatcctccttcaagggcagtgggaatcagggtcaggtccatggtgttaacagaatacacctccttggtgacttagcttggagtgtggaagaatcatctctgcttgaagctaccct

SEQ ID NO: 465808 - DNA, 463 bp, Homo sapiens
ttggagggcatatggccttctggctgacagagttgatgggcccaagcccaattactccatttgccagagtaccagagccctgtagggagttgagggttgtttatattaagactcagtctcttaatcactggaatgccttcatcttcaagattttcctgttatagtgttcagtcatttctttgccttgcaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgc

SEQ ID NO: 465809 - DNA, 2845 bp, Homo sapiens
  misc_feature (6)..(6): n is a, c, g, or t
ggaacngaagccgggagggaacgagggcggaagcggaccagggccaggcttgtgttcgcagccttgccgtggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465810 - DNA, 2851 bp, Homo sapiens
tactgcagtacaccccggagtaatgtagcgaggctgggtggcgccagggccaggcttgtgttcgcagccttgccgtggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465811 - DNA, 2784 bp, Homo sapiens
  misc_feature (6)..(6): n is a, c, g, or t
ggaacngaagccgggagggaacgagggcggaagcggaccagggccaggcttgtgttcgcagccttgccgtggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465812 - DNA, 2675 bp, Homo sapiens
  misc_feature (6)..(6): n is a, c, g, or t
ggaacngaagccgggagggaacgagggcggaagcggaccagggccaggcttgtgttcgcagccttgccgtggctggggttccgatgtggtccccggagcgggaggccgaggccccagccgggggagacccggcgggccttctgccccccgagtgggaggaggacgaggagcgcatgtccttcctgttctccgctttcaagaggagtcgcgagtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465813 - DNA, 2534 bp, Homo sapiens
ccctctttctggagcccttggatgcgtgtgtgccattgactaggatccttgtgcggtgaggtgcccgttgcatgggacagtgtaggacgagtttgttgtactctcgcgtgagtcgccgtcgcctgtctttcctgctggttccctctcttctgcaactcttccctaggcactgctggcgatgattgtaagttgttcgcgagacatggaattgatgtccgtcgttgtcatgtgaagcttttcatggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465814 - DNA, 1163 bp, Homo sapiens
ttgttcccagtaccttcccattggactggacattgatattgcccaggatggtctcgaactcctgcactcaagcgatcctcccacctcagcctcccaaagtgttaagattacaggcgttgagccactgcacctggccaacgaggctttctgaggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctgggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 465815 - DNA, 428 bp, Homo sapiens
tgaattgactaataatgcttaaaaatcaggataaaaaatttaataagaccatctgaatttcactttctcttgaataatccagcaaactgggaatgcattcccatatggcagtgatcttataaggttgagtggagtcacaccttagatggggccctgtgccttcagtgagctcaccatggcatcacccagcctggtcatctcttggttaactgtcaggcccccggtgacattttaattagtcattcctgaaggcaggcgcggtggcttatgcctgtaatcctggcactttgggaggccgaggtggtcagatcacctgaggtcaggagttcgagaccagcctggccaacatggcaaaaccctgtctctactaaaaatacaaaaattagctgggtgtggtggtgtgcacctgtaatcccagctactcagaa

SEQ ID NO: 465816 - DNA, 1157 bp, Homo sapiens
aggccagaggaagcaccgtgctcacgtctaggcctagcctacctgtggccgttctgtccattatgtataaatacaaacaggctgctggtgtctggggcttctgcgcatccactgactgcttttctggaacagacctgctcaggatatttcaggctcaggcatgtcatgtttcacgtgctggcagaatgtgggcctcctgttctatttctatccccttcggggtgacatacctcttcagatacttagccacgatccgcagcgcgtggatagcccaaatgtcactgattgggttgctgccctggtacgcaggccgtgtgatgggatttgaagggcaggggctccgcaggtgcaacaaaaaagcactgaatctaaaaaatgacttccttatggaagatatttaccattttataccttgcattgatcaaataccatattaccaaaagtgggtcatagctacaccagatttctatgaaaattacagtgtaatgagtgagaatatagactttggggtcagctgcccagatgtcaatcctggaacaagatattcctgctgcggacctggtggcctcataaagtttacgggtgagagaaaggcttttacactgatggatgatgggtcatgtttcgcctgaaatatattttatttgatctgtgttacgtttaaatttctttttttttttgaattgactaataatgcttaaaaatcaggataaaaaatttaataagaccatctgaatttcactttctcttgaataatccagcaaactgggaatgcattcccatatggcagtgatcttataaggttgagtggagtcacaccttagatggggccctgtgccttcagtgagctcaccatggcatcacccagcctggtcatctcttggttaactgtcaggcccccggtgacattttaattagtcattcctgaaggcaggcgcggtggcttatgcctgtaatcctggcactttgggaggccgaggattatgggtgcgagccaccgtgcccggcctaataaacatttttataaggtgctatttccttgcaaaggattaggttttaattatggtaaaaatgattttctgtcatattggaacaatgaaagggacctaattaaagatttttatccttgtttttatcaatacttatttatatcaata

SEQ ID NO: 465817 - DNA, 1401 bp, Homo sapiens
agctctctctccaggccatgggctcttcccaaatgttcacttgcaacccaagtcccaagattggcacagaggaagatgctgtgatctctacctgtctgatgcccatatttgatcaaatctgctgtgaagaggaggcactggggcaaggcaccagggaaagtgaagtccttcctggttctcaggccgaaagatccagaccatcatggactatctacacacacactagtctccccacagagccgctccagtggtttaacacaataggaccaccacccagaaggaacgcagacccagctcatcacaagcatcactgcagatttctagtgtccctctcattgcctgagaagagacccaaggaaactttggaggtgataggaatgtcctataccttgattgtgggggcggtttcatggaagtgtacgttactcagaagtcactgaattgtttgcttaaaagagggagatgagaataaacaacttcaacggcctttccatgcccaaagacactgcagcagagccgtctatgaatgacagatgaaatgccttagagtcttagttccaaaccacctccccggacagtcggaaatcccactggctggaggaataaataaattccttatcttgtcaaggaagctcctcccaagctacaaaagttgcagacagcaaagggatcaagtgaccccagagatgaaatctgtgactctctggtggagcaacatgatagtaataaacaaaggttgagtgcctgctgtataaagcaacctctggagtgcctgatatctactaactcttttagcacccactcgaccctgtgagatgcgtattactttattgtatctaccactgtaaaaaagaatgaaccaagctacagcaatattatgttgcttgccctgagtcacacagctgagtaagtcacaggagtttgtgctcataatgactttgctatgctgatgtttgaacctggaaccattcagcaaccctccagctaatatggctccatgctctacttctggaaaagctgagttcctgcagccttgtcctacatcacccaaaagagctggaaaagaatgcagtgagttccattctatttgttccgagaataggaaagccacattgaagcaatatcttaaagagaaatctatagttaggagtgatgaagatttgaaacagatgtcagcagaaagaaaaagggagaggcaccatgataattatactcagtgatgctttttaaatgacatatattcagttaaatatagggaggtttgctgctagccatatgaacaaagcacaagagaattcctggatcaaggcagacttaaagagacattgaaaaaaaaacaaaattcaaaattttgacctagtgcaggaagaagtgcaagtacaggggaagtggagggaagga

SEQ ID NO: 465818 - DNA, 1093 bp, Homo sapiens
gaacgggtggaggacttgaggtctgaggagctcgaggccgtgatgagggcgaatgccatttgtggagaatgggagacccgccgctttggtggtggaaatggtgatgctcttcgtttaggagggggaggaggtgaagccgttcttctctttggaggtggagaaggagagtatctcctctgtattggaggagagtatcttctaggagaagccgtcgaggatgaggggcgggagaaggagaccgtcgccttctggtgggtggtggggatggacttctcctccgtctaccatgaggggaagtctctttttggtgctttcgtggtgatggagaagcactccgggaaggggaatgtctccgccgcttgccaacctcaccattcttcacatgggatctcttgggtcgttcatcttctgaggagaaggaggaaccagagtcagatgaagactgctggttttgtcgtctgtattggcgtctctgctgagatcaatgaggaaggcccaagtgtccccacagtcttagggggaaatgtttgttatgatgtaaattttatttggattgaattaatgaatcctttcttctcactcatgcagagtgtgatcctatacagcaaagctgtcctcacaaacaatagttgactaaataaacacatggctttatggaagaaatgtattttattgtggaaatgatctcatggcaaagtttttaaagaggctgcagaacaataaagagagataacacattttgcttttatgaaaaagccgatgttccaaatttgctgaccttctctgtaaataagaagtgactgtcagtagccagcagatgtgtttataaaaataacccacttgatctgtccctgcaaggttctgtgaagcgggtaaaaacaaaatttggcatccagtttcaaaaggagaattgcaaactaatagaacatatagcacaaaatgattatatcaatagaatgctaattgcatatcaaggatatttggtataatacaaattattctaccttaaacatatggaaatttgtggtccatgatgttgtagattctatcttcccactctgcattttcaaaggcatatggtattgactcattc

SEQ ID NO: 465819 - DNA, 3105 bp, Homo sapiens
ttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataaggaagaagttcgtgctcaaaattaatcacacagcgagtaactagcagttctgggtgttccaattcttccaagatcacatgagattgggtgcatttggagtggcgtttgccacctttttttattctaaaaaaaagtttgtgcctcctcctttttgttttatcttttaaaaaattatacaagtagtgtcttattgcagaaaaaaataagaatgtacagaatagcaaacagacaaatacaaatcactgaaagtctcaccattctcagaagattctgatttatatgttcccaatttcttttctatgtgtgtaaatatatatagtcactcctcattatttgtgcattctatacatgagaattcacctgctcactaaaatttatttgtaacttcaaaattaatagttgcagtgctttcatggtcattcagggacatgcacagagcagtgaaaatttgagtcaccagataccctttttcccagctgaagtcaaatgaggcaacactctgtcttcttatttcagctctcatagtgtaaacaagtatcctttttgtgatctacttaataccatttatttttttgcattttgaagctttttgttaagattctactgcttaaagtggtccccaagcgtagcgctgaagcgctatttattgtttctaaatacaggaaggctgtggcttaccttacagagaaaatacatgtgttaaataaactcattcaggaatgagttatagtgctaagctttttattttcttgtcattggagaatttctggtattgtggtaatagagtaaatgaattcttaagtgttgaaggtttaacactacaaaggtatgtcaagtcaggttgtttctcaggttcttttttgggaggttatacttcatggtagaggataaggctcaaacgggaaattgtgacattttaataaattttaattttaataaaattttagtaaatttcagctctcatggtgtaaacaagtatcctttttgtggtctacttaatgccatttttttctgtgttttgaagctttttgttaagattttacttgttaaagtgttccccaagcgtagcattgaagcgctatttattgtttgtaaacacaggctgtggcttaccttacagagaatatatgtgtttttaataaaaatttagaagaatggattgaagtcaaaaaatagtttaaggatattaaatatgggtaatattcataagtcagaccactattaatcccatcccatagatgaattgaagaattgaatcataaactgtaaatggtcattgtgttttaattgtatttagaacttagaaagcctgagttaccttatttgctcacttcctttgaagaaggaagatcttttgatttcaaagagaatattgtttatggagaaaatgttctagtgagtaatgttactttaagtaaattgaagttgttcaggtttttttccgtgtttgatgggccccataaaaatgaaggtataggttctaagtcacattgtctgaactgcttaagctgttgatacaataaggaactaatagtgatcactaagcagattaaaacatttaaccaagggatagaggggcagaggttccatgcttctagaagaaagtcatttggcagtttcctcttagaaatttcacttgaccccaaagaatattagggtacttctgtcagaattctagagggccatacctctaactgtaccttttttgctgtagataataatcaccatactaactttaccatgtatgtgtaaacatgatttggtattaaatgatttaaggccagctttcaaggaataattatatttattgctattgttaatcatgtatctttattatgttcttcaaaaggattcagcagaaatttgctttgatttattagtcaaagcaaatgttcctagacattttacttaagttttttgcctgaagaataattctacatattaaggcatgttattaaagcaaattttgaaaatcatacattaacaggcctgtcttccaaggatatccattagaatatatatatatttattttt

SEQ ID NO: 465820 - DNA, 830 bp, Homo sapiens
  misc_feature (786)..(786): n is a, c, g, or t
  misc_feature (790)..(790): n is a, c, g, or t
  misc_feature (797)..(797): n is a, c, g, or t
  misc_feature (800)..(800): n is a, c, g, or t
  misc_feature (803)..(803): n is a, c, g, or t
gactcattctttgctctcctgctaccacgtgaagaaggatgtatttgcttccccttctgccatgttgtaagtttcctgaggcctccccagcccttcagaactatggggtaacacatagaaaaggcacggagaagttaagtgatttgcctgtggtcacaaagcctgttagcagcaaacccagaacaagaacctaagatttatgaccgccagttccagctgtttttcttcgtcatgtatcctcagcaatcaacataatcaaaatctgtttggagactactgatttgtataaaggaagataacaccgaacaaccaaacaggaagtaatccagcgaatctggaacagcggtggaatttagaagcaaggccagatgaggaccctaagacctagagaaactaagtcatttgctcaagaagacaaaggcatcgtctggtccagttcagcacagagctagctgcaagtgacaacctaagagaaaagtcagcgagaacaaagatccatctcttcgttgactgccttaatccctagagctgtgttcttcaatttgttactatttgctacaatttttctgcctaacaagcaagttctatcctgcctaggagagaaacttttagtaaattcatcttcattcactactattcagctcatgctgtaaaaacttagataatgctgtctgaaatacttaactcctggtcaaatgcagctgctatttcattcagtataatcaaagaatagccaaggactttagttaatatttcttcagatgatagagaataaatgggtgggtntttnccaggcnccnaangtggggttttttttaaaaattaaaagg

SEQ ID NO: 465821 - DNA, 802 bp, Homo sapiens
gagagcaccacacattgttgtgtatgaaatactctattcagcaaacaagccgtgcagcaacaagacctagtgtggtcaaggatggtggactaaaaaccactatgaaagcagagatgtagccacctctgagactggttttctaagcaggatgacttggttccatccctacaggcatcgtctggtccagttcagcacagagctagctgcaagtgacaacctaagagaaaagtcagcgagaacaaagatccatctcttcgttgactgccttaatccctagagctgtgttcttcaatttgttactatttgctacaatttttctgcctaacaagcaagttctatcctgcctaggagagaaacttttagtaaattcatcttcattcactactattcagctcatgctgtaaaaacttagataatgctgtctgaaatacttaactcctggtcaaatgcagctgctatttcattcagtataatcaaagaatagccaaggactttagttaatatttcttcagatgatagagaataaacaaattgttttggatatatctaccatgccctccaaacatgattgttgatatcttttctatataaattactttcctacataaatggtacttagcttttccttgaaagatatgctcttctctccagctcaaagataaccctctttccctcaaattataagtaatttatatttaataatctttcatacgaatttttaaaattacaaatggtaaggtaccactattttttattttgtaacagcacaaaccatcaaatcagaaaaaaagaaaggttgagt

SEQ ID NO: 465822 - DNA, 624 bp, Homo sapiens
gtgaagagcagagaactatgaagatgattcaggaagaggcacatggagactagagatgaggaccctaagacctagagaaactaagtcatttgctcaagaagacaaaggtaatcatcagaaatcaacatgagatttcagctctcctgatccttagtacaacatgtgaaagaagatatgttgtctttactcacagtggaggcatttttctagctgtgtttgatttggcttccctatagattcaggacccataactcttgttctcactcatctgctatgctgctgataaggactttcaggtcaacagctgtaactgctaaatgaagttaatactctggaaaaaaaaacaaatttgtgggggccggcttggggccctgggaaaaagttttcacaacacctcccctgtgtggggcgcgggggccccagttgtaggttatgggacacccttggccacacccgctggtcccaaagggaagcccctggcgccaggaccaactggtttggtttcccccccaattaaaaaacccgccggggggcaccccaggggttcgggccaacccagagggggcccggcggcctacgggctctcccaccggtccccgaagcagaataatcgggccgcggggg

SEQ ID NO: 465823 - DNA, 738 bp, Homo sapiens
gtgaagagcagagaactatgaagatgattcaggaagaggcacatggagactagagatgaggaccctaagacctagagaaactaagtcatttgctcaagaagacaaaggcatcgtctggtccagttcagcacagagctagctgcaagtgacaacctaagagaaaagtcagcgagaacaaagatccatctcttcgttgactgccttaatccctagagctgtgttcttcaatttgttactatttgctacaatttttctgcctaacaagcaagttctatcctgcctaggagagaaacttttagtaaattcatcttcattcactactattcagctcatgctgtaaaaacttagataatgctgtctgaaatacttaactcctggtcaaatgcagctgctatttcattcagtataatcaaagaatagccaaggactttagttaatatttcttcagatgatagagaataaacaaattgttttggatatatctaccatgccctccaaacatgattgttgatatcttttctatataaattactttcctacataaatggtacttagcttttccttgaaagatatgctcttctctccagctcaaagataaccctctttccctcaaattataagtaatttatatttaataatctttcatacgaatttttaaaattacaaatggtaaggtaccactattttttattttgtaacagcacaaaccatcaaatcagaaaaaaagaaaggttgagt

SEQ ID NO: 465824 - DNA, 612 bp, Homo sapiens
cggggtggacaaggggcagtcaagcagggcgcgtccttcaggtatgaggaccctaagacctagagaaactaagtcatttgctcaagaagacaaaggtaatcatcagaaatcaacatgagatttcagctctcctgatccttagtacaacatgtgaaagaagatatgttgtctttactcacagtggaggcatttttctagctgtgtttgatttggcttccctatagattcaggacccataactcttgttctcactcatctgctatgctgctgataaggactttcaggtcaacagctgtaactgctaaatgaagttaatactctggaaaaaaaaacaaatttgtgggggccggcttggggccctgggaaaaagttttcacaacacctcccctgtgtggggcgcgggggccccagttgtaggttatgggacacccttggccacacccgctggtcccaaagggaagcccctggcgccaggaccaactggtttggtttcccccccaattaaaaaacccgccggggggcaccccaggggttcgggccaacccagagggggcccggcggcctacgggctctcccaccggtccccgaagcagaataatcgggccgcggggg

SEQ ID NO: 465825 - DNA, 1788 bp, Homo sapiens
ggcggcagcgggaggctcaggcatgggggcctgcagatcccaagccctgccccacagggaggcagctgaggccccgcgagaattcgagtgcagcgccagcaggccggcactgctgggggaccccacacaccctccacagctgctggcccagttactaagcccctcactccccgaggcctgcggcccccagcggccacttggagtgcagggccgccaaacccacgcccacccggaactcgcgctggcccacaagcgcctggcgcagccccgaaaggggatcccacagtgcagcagcgggctgaagggctcctcaagcgcggccagagtgggcgctgaggccgaggaggagccaatagcgagcgagagctgccagcacgctagcttcttcacttccttgttctcaggtccattttccccaaacacaccagattgaaatttcaagaactctaatcccatctcattactatttaaaggcatttaatgaattctccatgacctgtgtggggaagcataaagagtgctacatgttttttatttgtgtttttctatttttactgttaaagagaacactgaacttgtctctctagcagcctcagtggttaggatgctgggttaattttactcccaaggaaagtgacgcctgagagaaagagccatttgtttgtctttttaatttcagcttcttcctaaataagacagccttttagaaagactttcacagtgtcaggttagttacctaaatcttaggtaactttaggttagttacctaaagtcactctgtgacttcatcctgatataaaggaacaaggaagagagtcggattaggctaactcactatgatggggtaacacatagaaaaggcacggagaagttaagtgatttgcctgtggtcacaaagcctgttagcagcaaacccagaacaagaacctaagatttatgaccgccagttccagctgtttttcttcgtcatgtatcctcagcaatcaacataatcaaaatctgtttggagactactgatttgtataaaggaagataacaccgaacaaccaaacaggaagtaatccagcgaatctggaacagcggtggaatttagaagcaaggccagatgaggaccctaagacctagagaaactaagtcatttgctcaagaagacaaaggcatcgtctggtccagttcagcacagagctagctgcaagtgacaacctaagagaaaagtcagcgagaacaaagatccatctcttcgttgactgccttaatccctagagctgtgttcttcaatttgttactatttgctacaatttttctgcctaacaagcaagttctatcctgcctaggagagaaacttttagtaaattcatcttcattcactactattcagctcatgctgtaaaaacttagataatgctgtctgaaatacttaactcctggtcaaatgcagctgctatttcattcagtataatcaaagaatagccaaggactttagttaatatttcttcagatgatagagaataaacaaattgttttggatatatctaccatgccctccaaacatgattgttgatatcttttctatataaattactttcctacataaatggtacttagcttttccttgaaagatatgctcttctctccagctcaaagataaccctctttccctcaaattataagtaatttatatttaataatctttcatacgaatttttaaaattacaaatggtaaggtaccactattttttattttgtaacagcacaaaccatcaaatcagaaaaaaagaaaggttgagt

SEQ ID NO: 465826 - DNA, 1674 bp, Homo sapiens
ggcggcagcgggaggctcaggcatgggggcctgcagatcccaagccctgccccacagggaggcagctgaggccccgcgagaattcgagtgcagcgccagcaggccggcactgctgggggaccccacacaccctccacagctgctggcccagttactaagcccctcactccccgaggcctgcggcccccagcggccacttggagtgcagggccgccaaacccacgcccacccggaactcgcgctggcccacaagcgcctggcgcagccccgaaaggggatcccacagtgcagcagcgggctgaagggctcctcaagcgcggccagagtgggcgctgaggccgaggaggagccaatagcgagcgagagctgccagcacgctagcttcttcacttccttgttctcaggtccattttccccaaacacaccagattgaaatttcaagaactctaatcccatctcattactatttaaaggcatttaatgaattctccatgacctgtgtggggaagcataaagagtgctacatgttttttatttgtgtttttctatttttactgttaaagagaacactgaacttgtctctctagcagcctcagtggttaggatgctgggttaattttactcccaaggaaagtgacgcctgagagaaagagccatttgtttgtctttttaatttcagcttcttcctaaataagacagccttttagaaagactttcacagtgtcaggttagttacctaaatcttaggtaactttaggttagttacctaaagtcactctgtgacttcatcctgatataaaggaacaaggaagagagtcggattaggctaactcactatgatggggtaacacatagaaaaggcacggagaagttaagtgatttgcctgtggtcacaaagcctgttagcagcaaacccagaacaagaacctaagatttatgaccgccagttccagctgtttttcttcgtcatgtatcctcagcaatcaacataatcaaaatctgtttggagactactgatttgtataaaggaagataacaccgaacaaccaaacaggaagtaatccagcgaatctggaacagcggtggaatttagaagcaaggccagatgaggaccctaagacctagagaaactaagtcatttgctcaagaagacaaaggtaatcatcagaaatcaacatgagatttcagctctcctgatccttagtacaacatgtgaaagaagatatgttgtctttactcacagtggaggcatttttctagctgtgtttgatttggcttccctatagattcaggacccataactcttgttctcactcatctgctatgctgctgataaggactttcaggtcaacagctgtaactgctaaatgaagttaatactctggaaaaaaaaacaaatttgtgggggccggcttggggccctgggaaaaagttttcacaacacctcccctgtgtggggcgcgggggccccagttgtaggttatgggacacccttggccacacccgctggtcccaaagggaagcccctggcgccaggaccaactggtttggtttcccccccaattaaaaaacccgccggggggcaccccaggggttcgggccaacccagagggggcccggcggcctacgggctctcccaccggtccccgaagcagaataatcgggccgcggggg

SEQ ID NO: 465827 - DNA, 448 bp, Homo sapiens
gtaaccagtactagaatagtcagtacctagaagccactcttctttgaaaaggattatcacctgatcaggttctctctgcatttgcccctttagattgtgaaatgtggctcaaggtcttcacaactttcctttcctttgcaacaggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcaggg

SEQ ID NO: 465828 - DNA, 1565 bp, Homo sapiens
cagggcactgcatgcatgggacaggatgctttcatggagcccttcggtgacacacttggggtctttcagtgcaaaatatacctccttctcttcggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatattatggaccttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtagctgaaatctatggaagttcacaaggggagtctcaacaccttggaaattacaaaattctactctcctttgcacacaagtcaaatgccacttgggcaaaatctgggagcaggtttggacaggacatggtggttaagatgcttattcctcaattattatccctgacaaaaatacctattttgtcttttcaggccagaaacagaatacaggaaagctcaaacattttcaggtttcatgctggcagctccatcccaaagagaagaggaaaagaagatttggcaggggccaggattgcttctttgtccccactgtaaccctcattatcatcaatattgactgtactgacttattataagttaacaaagttttggctcaggccacaaaatcacagggagccaagtttcagttttatttcccctcatgtcaccttaggaaaattatttttcttaaccgcaacttcctcttctatataatagggataaaaacttcccccttaaggttgctatgagaattaaataaaatgatataggtggagtgcctg

SEQ ID NO: 465829 - DNA, 1127 bp, Homo sapiens
gaaagaaatgagagaaagatggatctgagccttttaggaagacgtcttcatttgagatggtgtatgacagtagatagtgtcagaggtgagcatacaagagcagaagaatgcaatgtggctttggggctctcccatcaagaagtggggtccatttcctgatccctggagtctggactcaggagcagcctgtgacttgcactgacatcaatggataatgaaatggatggagacagagttgtgcaaattccagaagctacgccttgagggctcttgcagattttgcttttgacctcttgaaactgccctgagaccactaggaaggaatacctatctggttttctggaggaagagagtcacatggagaagaactgaggcagccaccaactgccagacatgtgaccaccagctctgctgaccccacagctcaaagaagctgcacagatgagctgaggccacactcttcagggaacaatccgcacagtcctgagagacagcaactccttgctcttctgagccactaggctttggaacagttcattgcctcttttacatgacatactctaattgcatcatcttgttcaatgctcacaacaaccctgcaaggttcttattaattttccattttacagataagaaaactgagcctcacagagtagatgcaaaaccgttaagtggcaggactggaatttgcactcacatctatgtggccctaaaggccaccctctccccatttcactggcccatcaaaaaccacagagaccagataacaagagcttgtcatagtgctgacagcagagctgaggtcccaaactgcagcatgctctgcattcttctggtcacagggcaaaggccatcaaaagggatcaagagaagacacaggagcttccaggattggagggactggggctcatggcctgagtatcattcacaaagaagccagaaaactccatgtgtccacgtgtccaggggcaggaatgcccacgcaggcactgtatcgctgcagctgaatacctgccagagaagctttgctaccctaaagccaaggccaggccttctaagaatgcgccacaccaatgaggtgacatgtcctgtgatggcctagtatggttatgtgctttgcctagaat

SEQ ID NO: 465830 - DNA, 724 bp, Homo sapiens
aggattgtggaggctgggatcatggggaccagcccatggcttggagttgtctggagcccagggctgctggggctagcctgctcagatttcttcatgcagactcaaaagcagcaagagaagaatccccaatgcacatgcactatttccattatttgcctgcataatatttatttgtattccattagccaaaacaagttacaagatcagaccagacccatggaggtagaggaagattcaacatttgatggcagagaaagcttttatcacacttgggcagtaatgttggttctacatatgtctggcagtgtctttgacaaagttacaggatcaaaattgaaaggagagcttttggattacatgctagccaagctaatgctgacttctgttcagagaaaatttggatatttattctttacactgaagatcccgacttccattacacaggtgcagatgggaaatcagaaaatatattcaaaagcattttaattttaaacatatgcacttgattgtttactatagatattctctgagtttgaaaaagcataaaggctcaaccaagataccgcaaaaataccaagcaaaaagcaagaaagcccttgccagatactggcctctcaatcttggactcctcagccccccataactgtgagccaataaatttatgttcattatcaattactccgtcttaggtattctgttatagcagcacaaaatgatctaagat

SEQ ID NO: 465831 - DNA, 581 bp, Homo sapiens
ggcaaatgttccaaatctgccactatgaaataattggcagcaaggatgggaaaaagaaaaacctcattttaatgcgaatgacttaccaggaaataaaacacaggacctcagatgagtgggcgttctccatagcaaaccctgcccacttaacagttttgccaagatatggtccagatacaggtccttacctctggtttggctttcacagtgaagccaaaccaggacagcttgttacacagagtctggaaagcagcccttcatgttgggattctggaattgggtcactgccgagtcagatttcaataaggaaaacatacttgaaaatcatgctgaccaactatattgatgacattaggctaatttgacatggtagacaagaaattccaagtactgtccaagatttgaaaatgactttggaactctctcaagaaatcccttatccaagaaatacggataaatagccatgtggagatgatcaacatcaggagtatggttgtacaaccagagctgatgaataaacttttaggtattcctagttttctttttcaataatataaatacattttaaacaatttatgtgt

SEQ ID NO: 465832 - DNA, 1513 bp, Homo sapiens
ggcaaatgttccaaatctgccactatgaaataattggcagcaaggatgggaaaaagaaaaacctcattttaatgcgaatgacttaccaggaaataaaacacaggacctcagatgagtgggcgttctccatagcaaaccctgcccacttaacagttttgccaagatatggtccagatacaggtccttacctctggtttggctttcacagtgaagccaaaccaggacagcttgttacacagagtctggaaagcagcccttcatgttgggattctggaattgggtcactgccgagtcagatttcaataaggaaaacatacttgaaaatcatgctgaccaactatattgatgacattaggctaatttgacatggtagacaagaaattccaagtactggataaaatgatctggagcatgccaagtaaatgaaagttattggatcttgaatcttctaccactaagaaagaggcacagtgctttttggacctctttggattttagggaagtatattctataattgaaagtggctctctgacctattcattatatgactgtgaagactacctattttgaatgaaactctgaggaagaaagggctctggggcaggtccagcctgcagagtaaccttccctcccacttggaaatcctaacaaaatcaaagatatccttgatagctaaagataggtaagtaggaattctacaagaaatcaccagcataatgttatacgaaatatcagtatggatccctagaatctagagggagaataggctttctgtcccaaagaactactcaccatttgaaaattagctacttgtatgctattgagctctgtctgaggtcaagtaaccatgaaaacagagcactgcatcattatctgggtattatcctatctaccaagttatgaggagtacaaatccattttatgatggaaatagtagacttgaaattaggtccaagcttgctggtccagagggtataaactactccagtgaggatagagaaatgagaaaattttggctaaaaaataacaaaaatggatctgaaaaattaaattacaagctagaggctacatggatcttaaaagaagaaccagcagtctgcagagggagggatgaggaagccgctgtggaatgcgtcacattaccttccaaatataatacaatagcttcagcttgtgctgatgtggaggcttatatggaaggagtagacagcaggagagcctgccgagcacagagattccaagctgaagttccagagttccagtattgcgttcaaactccagctctgtttcttaagtgctgcataaacctggcccagtttttaaactctgtgcatcagttttcctatctataaaatgcacattgtaataatagtacttacttcacgggctgttatgaaggctgggtgaattcagatatgtaaaggacctagcatagggttatatgagtgtttcatatatgttagctatttttattcttaatggtcatctcagcagatgctagctatggataga

SEQ ID NO: 465833 - DNA, 627 bp, Homo sapiens
ggcaaatgttccaaatctgccactatgaaataattggcagcaaggatgggaaaaagaaaaacctcattttaatgcgaatgacttaccaggaaataaaacacaggacctcagatgagtgggcgttctccatagcaaaccctgcccacttaacagttttgccaagatatggtccagatacaggtccttacctctggtttggctttcacagtgaagccaaaccaggacagcttgttacacagagtctggaaagcagcccttcatgttgggattctggaattgggtcactgccgagtcagatttcaataaggaaaacatacttgaaaatcatgctgaccaactatattgatgacattaggctaatttgacatggtagacaagaaattccaagtactgttctttgcattattggtaactgtgtctgctgtgctttggaataaggtccaagatttgaaaatgactttggaactctctcaagaaatcccttatccaagaaatacggataaatagccatgtggagatgatcaacatcaggagtatggttgtacaaccagagctgatgaataaacttttaggtattcctagttttctttttcaataatataaatacattttaaacaatttatgtgt

SEQ ID NO: 465834 - DNA, 1937 bp, Homo sapiens
tggatagagggactccttgtgtgtgtgtgtgcagcaggggaaattgatgtacactgtcacagagatgaagtcccgtgataggctgtctgcaagttggagaaccagagaagtcaatagtgtggctcagtctggaagccagagaaccagagtccaaaaaccaaagaacctggagtctgatgtccaaaggcagaggaaaaacagcatcccacttcagaaggaagacagcacaaggtgcaagctgttgatggctctaccatgctcaggtctaaaggacagtggccccattctcacagctccactaggcagtgccccagtggagacctactacctgacatttcccttttgcactggccttgcagaggttctctgtgagggctctgtccctgctgcaggcttctgccttggacacccaggcatttctttagaatccaccactctcgcactctgcacacctgcaggcttaacaccacattaaacagtgctggcaactgctcagcttctgcagaggatttaggaggcttacaatcatgacagaaagtgaaggggagcagataagaaaactgaaattttcaaagaaggtattttgttattattgctgacatttcacccaacatataagcataaccagaatgaagattttctattacctatagatatatattttaatatttgtacagttttatgtatttaaaacttcaagtttttctttgaattattgctgaaaaaatgcataaattttaagtggtcatttagatagacgttaggagcttatgtaattattatttatttattttctaccagttctaagaaggcacaattggttaagattagaccatcaaactctgattaacagatttttaataattttaggaaatagatgtttgagttttgcatattttctatagcatataatggtatataatagcatatactaagaaaacaaataaatgtactgattttcttcaattcttttcataatttttcaggtttatctatccatacctcccttgaaacacatttaaagaacacagaaaagcctttaggaacagattagctttaatcttgtgaaagaggagtaacaataatgcaacacagatatataaaactgcctcttgtctggggccacaatattcatactacctctgaatctaaaatgaccctgtctgatgtagaaattatattaccgtcattgaagttaccttcataattactaatatctatcaaacatcattgtattattacagcttaatgtattctgaggttatttgaaaaaaaagtagtccaaatattttagcagataataattcacattttcttcatattagccataaatatgaattgattctgatttttataaactaacatgtacataacaagttcagtagtgtttttattatgaaaatagttttctcagataaaatgaagagtcctgaggacagctgcagaaatagctacacatgttaaagagggaataacatgctgcataagattagtatgtcatgcagttctcttagcaagatgtttcttagattatgtgtgtacacagagtgtttcacctataaattcaggttaagtagtttcagttgcaaaaccaagtagttcaaattaagtaactactaagttggaataatgactgcctaaattgactaattgaatattgaagtaagaacagttaaccttcaaatgtcttgtatgtatatcatcatgaccgtttattttgtttgttttaaaataaatgttaagtttctattcttataaaacaggtttcttctaactgattgatattaatcaaatattgccaaggttattatatagtggtgcttacaaatccaaccaaatatcctttgcatagaattgaagttgcctcagtaccatgctgttttggttaccgtagccttgtagtatagtttgaagtcaggtggcatggtgcctccagc

SEQ ID NO: 465835 - DNA, 1795 bp, Homo sapiens
tccagcagccaccatcaccaccactgcggttgctgctgcagctgcagctgctgctctccctccggctgcttcttcgcgtggccagcagcgaatggagcgatggagcccagactgttctgctggaccactctctttctcctggccgggtggtgcctgccagggttgccctgccccagccggtgcctttgctttaagagcaccgtccgctgcatgcacttgatgctggaccacattcctcagaattctggaatgctccacggtcaagtaaacacaaagaagaacaaaagccaggacggtcaccagtggttgtgtaggctgtgtactgcacaactccaaagtgtgctgggaaatgtgccccccttgcagctgtgcaacactgtggtcctggaggaaaaggagggaagagacagaggaacacatctaccgaagactcaggaggagcccagaagacagtatcgtttgttcttcaagagagaggatgggggccacatctgtcagagctcgaggtggcagaggctgctgtggtttcctgggggtccactccagacctgggtccctcgtgcaagtgtcatcagtggaggttacagaacagcaaagatggctgccgctccttcccctgggctgtctgtcccagaggggcaccaacctgatgccgagccctcaggggtaaagactaagtctgctgattcatggagaccacggctgcctctccctacaggagctcagtcccaggaagatcagagtgctgtccctaaacccaaggctggaggctgctggcacccggggctgggcccatccggacctcgcccccgctgccctccgccgcctccaggcccttccctcgcccatcagggaggacagtgtcgcagagagctgcgactccggcatgggcccacgtgactaccccaaaagcaagtgacatacttgcagggtcgtctttccttacttgcccccaaggaataggggtctttggcatctgaaggactgctggattccaagattctgccatcgctgctgctgccgtccatgtgtctgtgatggctggtgggaacagcactttccttttgtgggaagatggtgtggtgtgcagtagtggtcactgttggagagatgtttatgtcttgtacatgaagagctgctctccctctgatagctgcctgccaagcggctccatccatcattgagagcgggcaccacacggctcactgccccaagcatcttagactaaacaccagctagaatgtggagttaggcaatcaagtgtgaaacttaacttgtacttgtcttagaagcagcaaaggcagctgggccagctgatagacaaggaacgctgtcctcccagaaccagccacgggtgcagatgatgggcactgcggagcctgctgtcttacagaagctgatcctggagggtgcctttcaatcctcgatgtcaggaggttttcttttagaaaacaatctgattcagaataatgactgcaatttttcactggatggaaaacaagtctagaggaattgacccttattttaagttcaaagatagtatatccttgttactactgttacatgttttatagccaatcttcaagaccacctctgggcaatgaagttatttgtgatggaaacacttaggttcttgattaagtgaatattaaaaaaaaatcactatcagagaaaagtatacctgatacaatgactagaactgaaaaattatgaacaaatagcaaaacaattagtactatttgacaaaaagaagtaatcaccaatataaaactttggtatgatgttctaaacatac

SEQ ID NO: 465836 - DNA, 4122 bp, Homo sapiens
agcagtcaccatacattagttaagcttcatcaagtgtcagcaaattctgcaccctcatgaaagatggaatataattggcattacttcttatccatcgcaggaatatgtagggttttggctgtttctctttctgtacccattcaagaatggctttgtttaaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggtggaacctgggaaagaaaaaacagaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggaaatagaacagcaacaaagaaagagttctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgattatacaagagaaattcaagagataattgcccatgaatcgctgattttgacctactcggagccttcagaaagtgctacatctgtcccaccctctgacacaccttctctcacatcatctgtttcttcggtctgtaccacagatagctcttcacccattactaccctggatagcataaccacagtttatacagagccagtggacatgataactaaatttgaagattctgaggaaatttcttcatcaacttattttccaggcagcattatagactatccagaagaaataagtgtatctttagatcggactgccccaccagatggtagagctagtgctgatcatattgttatttccttatctgatatggcatcttctatcatagaatctgtagtacctaaacctgaagggccagttgctgacactgtttctactgacttacttatatctgaaaaggacccagtgaagaaagccaagaaggaaactgggaatggaatcattctggaagttttggaagcttacagagataaaaaggagttggaggccgaacgaacaaaaagtagcttatccgaaaccgtgtttgatcacccaccttcttctgtaatagcccttccaatgaaagagcagctttcaactacatactttacatctggagagacctttggtcaggaaaaacctgcatctcagttaccatctggcagtccttctgtttcctctcttccagctaaacctcgcccattctttagaagttcttctttggatatatcagctctctgtcctttcctttctaatgatgttggcccacttttatgactgaatacatattaaaatcaccattcaaattat

SEQ ID NO: 465837 - DNA, 2248 bp, Homo sapiens
agcagtcaccatacattagttaagcttcatcaagtgtcagcaaattctgcaccctcatgaaagatggaatataattggcattacttcttatccatcgcaggaatatgtagggttttggctgtttctctttctgtacccattcaagaatggctttgtttaaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggtggaacctgggaaagaaaaaacagaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggactgatgggagcaagattggggtaccgagc

SEQ ID NO: 465838 - DNA, 6872 bp, Homo sapiens
agcagtcaccatacattagttaagcttcatcaagtgtcagcaaattctgcaccctcatgaaagatggaatataattggcattacttcttatccatcgcaggaatatgtagggttttggctgtttctctttctgtacccattcaagaatggctttgtttaaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggtggaacctgggaaagaaaaaacagaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggaaatagaacagcaacaaagaaagagttctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgattatacaagagaaattcaagagataattgcccatgaatcgctgattttgacctactcggagccttcagaaagtgctacatctgtcccaccctctgacacaccttctctcacatcatctgtttcttcggtctgtaccacagatagctcttcacccattactaccctggatagcataaccacagtttatacagagccagtggacatgataactaaatttgaagattctgaggaaatttcttcatcaacttattttccaggcagcattatagactatccagaagaaataagtgtatctttagatcggactgccccaccagatggtagagctagtgctgatcatattgttatttccttatctgatatggcatcttctatcatagaatctgtagtacctaaacctgaagggccagttgctgacactgtttctactgacttacttatatctgaaaaggacccagtgaagaaagccaagaaggaaactgggaatggaatcattctggaagttttggaagcttacagagataaaaaggagttggaggccgaacgaacaaaaagtagcttatccgaaaccgtgtttgatcacccaccttcttctgtaatagcccttccaatgaaagagcagctttcaactacatactttacatctggagagacctttggtcaggaaaaacctgcatctcagttaccatctggcagtccttctgtttcctctcttccagctaaacctcgcccattctttagaagttcttctttggatatatcagctcaacctcctccccctcctccccctccccctcctcctcctcctccaccaccaccccctcctcccccaccacttcctccaccaacttcacctaaaccaactattcttcctaaaaaaaagttaacagttgcatctccagtgactacagctacacctctgtttgatgctgttactactctagagaccacagctgttctgagaagtaatggattacctgttacaagaatatgtactactgcacctcctcctgttcctcctaagccatcttcaattccatctggacttgtatttacccacaggcctgagccaagcaaacctccaatcgcccccaaaccagtgattcctcagcttccaacaactacacaaaaaccaacagatatacaccccaaaccaacaggcctatctttaacttcaagtatgaccttaaatttagtgacttcagcagattataaattgccttcccctacctccccactttccccacactccaacaagtcttcaccaagattttccaaatccctcacagaaacttatgtagttattacattgccatctgaaccagggactccaacagattcttctgctagtcaagcaattaccagttggcccttgggatcaccctccaaagatctggtttctgttgaacctgtgttttctgtagttcctcctgtgacagctgtagaaattccaatttcttcagaacagaccttctacatctctggagctttacagacattttctgctacccctgtcacagcaccctcttcatttcaagcagctcccacatcagttacacagtttctcactactgaagtttccaagactgaggtttcagcaaccagaagtacagctcctagtgttggtctcagcagcatttccataacaattcctccagagcctcttgctctagataacatacatttagagaagcctcagtataaagaagatggaaaattgcaacttgttggtgatgtaattgatttgcgtacagtaccaaaggtagaagttaaaacaactgataaatgtattgatctttctgcttctacaatggatgtgaaaaggcagatcacagcaaatgaagtttatgggaaacaaattagtgctgtccaaccctctattataaatcttagtgtgacatcatcaatagtgactcctgtatctctggccactgagacagtgacctttgtcacatgcacagctagtgcaagttacactacaggcacagaaagcctagtgggtgcagaacatgcaatgacaacaccactccaacttacaacatcaaagcatgctgagcccccatacaggataccaagtgaccaggtctttcctatagctagggaagaagcaccaataaacttatctctaggtactccagcacatgcagtgacattggctattacaaaacctgtcactgtgcctcctgttggtgtcacaaatggatggactgatagcaccgtatcccagggaatcactgatggggaagtagtggatctcagtacaaccaagtctcacagaacagtcgtaacaatggatgagtctacttcaagtgtgatgaccaaaataatagaagatgaaaaacccgttgatttaaccgcagggagaagagctgtgtgctgtgatgtggtttataaattaccatttggaaggagctgcacagcacagcagcctgcaactactcttcctgaggatcgttttggttatagggatgaccactatcagtatgatcgatcagggccatatggttatagagggattgggggaatgaagccttccatgtctgacacaaatttagcagaagctggacattttttctataaaagtaagaatgcttttgattattctgaaggaactgacacagcagtagatctgacttcagggagagttactacaggtcagtatgatgtggcagcagacctttccttgaaatatcattatggtgttcctcatctcatttcaggatgaaaatgtggcttcttttccagttttgttactttttctctttctttggatgttatagcagcatattttggagtacaagtgcgcttttgttccttcattttaaaaaaaatttgttctgctcaaaatcactgcatgcgcctgcatgttcaacattgctttcattccgcatataattaggttaccctgtggatttgcatgcagtctcattcattatgttcatcaagatgagagggttttcaaactcaaaaagcatcattcattctgggaactggactataactctgccctgtatttcaggtgaggtaatggattattcaagcaagactacaggtccatatccagaaacacgacaagtcatttcaggagctgggattagtaccccacagtattccacagcaagaatgacaccaccaccaggaccccagtattgtgtggggagtgttttgaggtcatctaatggtgttgtctattcttcagtagcaactccaacaccctctacatttgctatcaccacacaacctggctccattttcagcaccacagtgagggatttgtctggtattcatacggctgatgcagtgacttcattacctgccatgcaccatagccagccaatgcctagatcatattttataacaacaggtgcatctgaaacggacattgcagtaactggtattgatatcagtgccagtttgcaaactattactatggagtctcttactgctgagacgatagactctgttcccactttaaccacagcatccgaagtgtttcctgaagtggtgggagatgaaagtgctcttttaattgtccctgaagaagataaacaacagcagcagctagacttggagcgtgagctcctggaactg

SEQ ID NO: 465839 - DNA, 999 bp, Homo sapiens
tgattttgacgattatttttagatggttggtgagctctgggacagatttcaaacaagatctttcttggcaccagtcaaaccaattaatttaattcttcagcatactattcacagtggaagcctcctgtacgtaaatgttccttccaagagctcacacaaagacctatatgtgaacgtttataacagctttattcatgatctccaaaacccagaaacaaccaagatgcccttcagcagtggtcatgtgcagtctacaaatgctgatgatgttgacaaccccttgggagacatcgcatcgctagccaagcagcggtactctaagcctctttatacaaacacaagtcgtgctgcaaatattccaggatataccggcaaggttcatttcacagccacccacccagcaaattctaatattccatcaacaaccccatcaccagattcagaactgcaccgcgtcttccagaaagaaatggcagttgacctcttccgtcaccaggctcccctgtctcgactggtcacaactgtgagaccctacaaccctttcaacaagaaggacaaagaaaccatagactactagaggaggcggccctgcgcgggctgtccaggcctccgcctggggaaggcttgtgcggcggtgggaaataaaggctgcttctccgcgctgcgcagtgtggtgggttcggtgctgttctccgctggcctgcgcgtccctgcccagcccgcctctctcccccggcaggcggcgctcagctggacactgggcgcccgccagccgcggcgcagactcccaagccgccggcagcagggtagcagggcctgtgttgcagaagattcctctttagggttggaatattgggtctacctagaggtttcacatggcaccacttcagtgcagggattctagagcagagagcagaccatagattttagaatctcaaaggcagtctagtcaaaaatccgtatgctgtcagtgggaaccctgagctactgagaaagtgc

SEQ ID NO: 465840 - DNA, 2743 bp, Homo sapiens
  misc_feature (123)..(124): n is a, c, g, or t
  misc_feature (126)..(126): n is a, c, g, or t
  misc_feature (129)..(130): n is a, c, g, or t
ggagtgggtacattctgaaaacctgagaattacccctttgacatgttcccagtgataagcaaacattatgaacgcagcaagttgagaaatatcaacattgagatgagactcaagagaccgggnntncannaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaaggtaaaatcttatgttttctatattgctggtttggcccagtctgcctggaataagtagaccctttacaatagaaagataattgtttttcagatttttatttatttccagttctgtgatgacttccctctcagtaaacagcaatccgattccagtggacctgaattattctaaacaaacaaacaatagcaacaaactgtgggggaaaattcagagttcccaaaacataaatgaattagtatgggttgtcactcttttctcctcacgctgtttatgcttttgttttaatctagaaacattgtattcattggacattattttcagagaaaataactttttatcttaacatctcatcccatagagtaaaatttcaacaagtagtctgacttttaataataagagtttatgatgatgaaaattcattgggcaatacattcacccccaaaaatttgtctggaaacttgtgttccaaaatagaatctgtggtttagattttaaaatagatttaatatacattcctgaaaaagagattaccttaaccacaataaaaagaagacaacacatattattttcattcttaactctaggggaaaaaatgtaaacattagttgcaaaaagctattttagtgtatggaaggatgttcttgggaaaaaaataaaaacataaaagggagagaggaaataaagaaaccacggttttgtgaggtagtactttcaaagggatctatgtatctcagaagctagtcaacaggttttaagtatgtggaattgtagggttttatataaaaatggaagatacagtctctactcttaaggagattaaaacacaaacatctcctcaattgacaaggtctctttccatgctttctatctgggctaagagacttatcctt

SEQ ID NO: 465841 - DNA, 5437 bp, Homo sapiens
ggaaagaacttctcccagagggaaccccaaaagcccagaaaagttcttgacgggcagagaccacgtgctccccacagggttttgcacaggcagtcattgcacccagcagtcgtaaccaagagagctgccaccttggtgccagggcttaaagaagacatgtgtgaccatggaccaggaacgcccacgctctgacctcagcataaacaacagaaatgatcttcgaaaggttttgcatcttgaatttctctataaggagaacaagtggttccatgaaaaaaccagcaagttcactcgcagcctagatggtcgtgcagtgccagctgccatcctccacggtcagcggaatgcctgccgtgtccctcccactgtgtcactcagggtgttgaagagcagctccacccaaccccaagaagagagccggaaggtccctgagctctttgtctgcacccaacaggacattctggcttcgagcaacagctccccctccaggacctccctgggtcagcttagtgaactgaccgtagaaaggcagaaaaccactgccagcagccctccccatctgcccagcaaacggctgcccccatgggacagggccaggccgagggatccctccgaggacaccccagcagtggacggcagcacagacacggacaggatgcccttgaagctctacttgcctggtggtaattccaggatgacccaggagaggctggaaagagcgttcaaacggcagggcagccagcccgcacctgtcagtctccttggtctctcagaacaagcctgcgaagtaaccggcaaggtagagtttgttatggtcaaccaggaagaaaactcagccagagctcacacacctggaaagctgaagaatgctctagacaggggtgtccaaccttttggcttccctgggccacattggaagaacaattgtcttgtgccacgcataaaatatactaacaatagttgatgagctaaaaaaaaattgcaaaaaaaactcaatgttttaagaaagtttatgaatttgtgttgggctgcattcaaagccatcctgggctgcatgtgggctgcgggttggacaagcttgctttagcagatggtcccaaaacatacctgcagcaacatggccaggcagacgtggctaagagtttcttgtgggaagccagagatacagtgatgaatcagctcccacaaggctccctttgggcattatttctattttattttatttttcatcctatccttacttttattctttacaataagccttaatgattcctacattgattgatttctgaatgttaaaccaaccttacatcctaagaataaatcccacttggctatgatatattatctttttatatatcattggatttgacttattaatatttcgtgtaggggttttgtgtgtaggtttatgaagaagattggctggcagatttcctttcttgcaacagctttgtcagatgctgatacctaggttatgctagaagtggtccctctttttctatccccttgaagagtgagtgtaagattgatgtgatttctttcttaaatatttgggagaatttactggagaaattttctgtgcattaagttgaaaggtgttaaattatgtgttcaattaaaaactttttaattcaaatttcaactttcttcttgtgtaagttttggcaagttgtattttttcaaagagtttggccactttatatgtgtgttttaaatttattggtataaaattgtataattatattatcctcttattatcactttgaagtttgtgagatctgtagttatgtctttgtttcattcctgtgattggtaatttatgttctttctctcttaactagtctcactgggaatttatcatttgtgtaatatactcaaagaaaacttttggctttatgtttgttttctatttcattgacctctgctcttatttttattattttcttcattctattctctctgagtttaatttgctattattttctagtttactgattctcagccttcttcttttgtaatatgttttaaagctgcaaatttctctgtaagtaatgttttgtctgtattccgtaagttaatacgttacatattcgtataacttagttaatatattttctaattcccatcgtggtttcttttttttttttaacccatgggttatttaggcatgtactactaatttcatacatttagggttttttttgtttatatttatatatatattatatatattgtttatttaattgtttatatatgtattattctttatgattgcaatcctttgatatttgctgagatttccttctagtatatagttaaagcctatctctgataaacagcatgtatttggaactttaaatccagtcgataattttttattctagttggaataattatggcatttatattttctttttactcgaataacttcctttagtatttttttttagcaggtttaagaggccacctgaattccttggctcccttccttcacctttgaagccagtgacgttggctgaatcctgctcaggctgccttctttctgcttttccccttcctgctccctcttctgcttttgaggacctttgtgattaccttggacccacctggttgatccagaacactcagcatatctcaagttttgtgatttttctagaaaatggtcccatctgtcagttttcagatgtattggtttgaacttattcatactagtttcttcttactgaaaagctcctattgataatgtttagttttatccttccttttcactcttagtattgtttatttatactctcttctctttatcaatcttgccaaaggtttgcctttttactaatcttttaaaagaatcggttttgaaggttgttgaatctattattttttatttcattaactttttcatcttgcatttatttttcctccttcctactctcttttggtctattctgttgttctcttttgctgggggatgcttactttgctttccactgttccacaataataggtgcctttatgctatacactgccctctccatattactttaactgcttcccgtaagactttataagttgtgtttttaatgttaaccattttgaaatattttctgccattatttctttaaaattttctaatgcatgggttattttgggggagtgtagaggagctatctctttatcattgaattctttttttatttctttgtaatcagaaacacagtttggaattttttgagacataatatgtggactgctgtatggtcaatatttatacatttgtgcttgacaagaatatattatttaacagttggatgttttggatcaaacatgttaatttagtgttcaaattttagtctttattcttattaatgttatttttctgcttgatctgttagttgctgggagagatgtgttaaaattttctattatgctcacggattgaagagtttctcctcgtagttctgtcaaatttttgataatatgttttgaagctttgttgttaggagcatagagtttcatgatggctacatttttctgttgaatttttccttttattattctctaataaaataatattccgttgtatggatatataacattttatttatttactcatttgttgattgacatttgggttgtctccaccttttggttattgtaaatagtgctgccgtgaacatttacgcacatgtatttgtttgagtccctgttttcagttctttgggggtgcatactgaaaaatggaattgcagaataatgctatttttaactttttgaggaactcccagactgttttccacagtggcacttacttgtgaattaactgaaatgtattttttttctactcttttcacatttagaaattatacactatgtttttattgttctagtggttacttctaaaattttaatcttaattgactttaatcaatccctctaccccctcaaaaaaatgtgagattttaagaagctttaactctgatgattgtttcccattcccatgctcctgtttattatgtctggtgttttagtttcactttgtttttaactactcttaaattagttgctattattattttaattgtttttattgtcggttctcatttaggtttatctaaatgcttgccgatttcttttcttcctgatatgagtccttgatcgttcattcagtgaaggtctgtgatactaaactgttttaatccttgactgaaaatgtcttcattttgttcttacttttagtgatgttttagttgggaatttcaaagttgacagtttttttctttcagctttgaagatgttattttattgtcttatgcccttgtcattgctattgagaagtctgctgtaactgtttataggtaatctgccttttgtctaagatttttctcattgtcttttgtattccagtagttttaaaatgacatgtctaggtatgcatttatttttacatgtccatttgaatctcatgtttctatgagaatgcatgtctggaaagttcttagcaattaccttttcaggtatttcccttcctaaattctctttattctttcattctggagcttcttttatatgtatgttggactttagaagtttttcctccatttctcttatttatttgctccttcgtgcagtttatctctctcctgatggtgatattctgagtaatgtcatctgatagctcttagtagttaatgatgtcttcactaatctactgtttatgtttaccaaaatatttttccaaattttaaggaagttcaaacctgtaaaaagcttgaaagaagagtacaatgaatatctgtagacttttcacttaaattcagcaattgctcattcttccaccagtccccacaggaatgcctgtagaatcctggtggtgttgggcagaggggttttgtggttttgaattaaggcaaatgacttgactgagttgaggaggacacatggaggatgaggactgcctgggagggagggtgagggagttctgtgttctagcgccagtgaaagaaacctggagtctgaagaagtgtgtactcagagatttggtactgtgcgtcctctagctcttccattcacgccccttcatacatcttcaggaggaaaccaattcaatggagtgcaccagggcaagattacgattgttacttcaatcatatcttaccctgcaaggatgttgaaggaaaatatatttcaatgccacactcaaaagagctgtcactttttaacatagtaaatgggttttcagagagtgatgtaatattgttatttttaatacattctgtttagaaatgattttactttagttcagccctaccccttatactcttattaccttcctttcccataagcaaccattctcttatgcttaatctatatctttttcttgtgtatgttcttgcaaaatctatactgttttgtatgcatcatttttacttgacat

SEQ ID NO: 465842 - DNA, 772 bp, Homo sapiens
ctggtgtgctatgaaaaaaaacaaaaccaaagcttgtgctctggctgcaccccaaagcaataaaatcagactctccagggatgggaacaaggcagcagtggctttaaaagctctccaggatgtgaactgtgaccatttgaacagggcactgctccgagtgttattttcaagtccctgttacagagatcatgtcagaagactaaggcaccaccagcagcaccggactgggcttaaagtacatgtggaagggcgagcctcccaggattctcaaacagaagcagcctgccaggctgagccatccagaagaccccctccctcttccctgagctctgtttcttccatgaggttgaagaaaaatgccgtcgtggtcccctgcctgcttactcagcgtgtcaagcaggagttctcagctccagtgtgccatggagggccttgggaagaggtcacataccattcccatccccaggcacaggagcactgaggacccttcttgacctcctggatcagaaaggcagaggaaatgctgggcagaagtcaaggtgtcagtgggctgccctccctccggaggctccaggggagaatctattcctcgcctcttccaattgctggtggctgatggcacaccttggcttgtggccacaatactccaatttctgcctccatggtcacactgacttcatttcttctgtgtgcatcaaatttctctctgctctgtgattgcatttagggcccctggatcagcaatgtcataaaagaccccagttcttcccct

SEQ ID NO: 465843 - DNA, 6253 bp, Homo sapiens
gccctacaggtctgattctgggtcccggaggaagagacggcacagcagtggcagctcccacagcccctccctctcctcccactacagtgattccagatctcccagcaggctgagccccaagcaccgagacgaagggcgaaagacgggcagccagcggtccagcggaagccggtcgccttccccgtcgggcggcagcggatgggggtcgccccagcggaacggcggcagcgggcagcggagcggagcgcacgggggccgccccggctcggcgcacagcccgcccgatgtacgtacgcttcgctttgcggagggttcccgcgccgcgggctgcgccgtgcgtggtcgggcgggtcgccagcggggcagggggcgataagtgtggcatgggggcgggggcgggggcggccgcttcctccctcctcggctccccgctgggcgtcctggctcgggagccgccgggagtgctaggccgttgcgcccacctggccctggtgtcagggtgaggggcgcctgcggtcttgggccacccttgcgcttggcaaactgaaggccagaggggggttgaccgcggggcactgagttgggtacagggctggggaggaatcagggtctcgtgccctccccaggcatattagggtgggaggggcatggacattgataggagtcccaggcaggagcaggattcgagagacaggaccccccactgggcaccacctgggccctgagtctccctcttcccaccaagccctggccccacctctgagcacccccctccccctccctcaatcttctccccagcccctccctccctcagccccctcccccatctcagtccctctgccctctaaagtccctgctctgaggagactctgcccttttccaggcaccgcccacacttggactggtgtctcaaacctgccggctcctcttcccacggccaccctcctgaggcacctgccagcgtgcctcagagaccccacaccaacacccccaaaactgtccccacccttcctccaagaggggcacagatgcccgaagacctacaggcaggtgcaatgggggagctggcagaggagagagacgtctcagcctgtccccagatggatgggctgggcctgggttggggcttctcccagaccccagggaaggtccacatccccttctggtctgttgattatagagtacacagttgagacccctcagagagagggggctgcagtgctggcaggggcactggggtgggtgggggggtggcttggggtggggagacctgcaggttccttcccagacccgcagactgccccccacccaaccccaaagcctcagctgggagtgggagagctgcccctccccagacctcaggtctcagcagcaaacatgtacgtgttggagttggaggctacagtgagctatcatcctgtctgtagtcccagctactcgggaggctgagtcaggagaatcacttgaacccaggaggcagaggttgcagtaagttgagatcgcaccactgcactccagcctgggtgacagagcgagactccatctcaaaaaaaaaccccaaaaaacaaaaaaccctacagtgtccggggctgtctggaaggtgacacccttaggtgagggtggcagagaaggctcaggatcatggccttggggctctctctggcttctccctgtggtccaaattttatcatgtaatgggcagcctcgggtgacccccaagaagaggtgccaaggcaccccctgacctgccttatacaggaacagaaaaaggcaaaagggatgaattttgctaaaaggatgccaaagccagagggaaaggagtgggactgacctgaggcagggccactcctccagatcggctctgtggttgccttcccttttaaatgcgcgttttcccttcacccatctgtccactccgattggccttgtttaaacagtgcttgtctcctctttctgtctgggggcacctttctctcttcctgcctctctgtttctgtttgcttctgtcattgtttctgtctttctgtttctctttctccttctcttcccatttctatctctgcctgactttgtctgttcgtctgtctctctgtctgcctcctgtctctctctcttcctttccatccctctcccccggcatgggcctctctcccatgctgccagcccctctgtagcccaccctgtggttctcttccatcagctgcttcctgcatgctctatggaggttttctgttgtttgaacaataaagaaagcttggctagtggaacccattgtttaaaaaggagaaaaaaaaaagagcaaacagaaatggccgtgcaagagccccctcccatccctgggatgagacaaaagccacattggccacccatctactggctcagagggggagcacagtttagggtcactgtctttcccccattctgcattcccaatgcggagaccttcttttcttttttattattgcattcctgtccctgagcactgagaagaagcccagctcgccctcgcccagggtccgtgacaaggcggcggccgccgcacccacgccgcccgcgcgggggaaggagagcccgagcccgcgctcggcgccgtcgtcccaaggtcgcggaggccgcgcggcgggcggggcgggcaggcggcggcggcggcggcgtaggcggcggcgctcgcggtcctcggcgtccgcgccccgccgcaggggtcgccggcgcccccggcccgcgcccccccggggctcgtcgcgctcgctcagcagggcccgctccagcagcgactccggcagcggccgcggcgcccccggccccgggcccgagcccggctctgagcgaggccacggcggacacgggaaacgggccaaggagcggcccccgcgcgcgcggcccgccagcacctctccgtccccgggcgcgcacggccggcgcggcggcccagaagggaagagctcgtcgcgcagccccggcccgcacccccgctcctggagctccagccgctcgccctccaaatctcgctcgcgctctgcggagaagcggccccacagccccagccgctcgccgtcgcccaagaagcccctcagccgggacaaggacggcgagggccgcgcaaggcactctgaggccgaggccacccgcgcccggcgccgctcccgcagctactcgcccatccgcaagcggcgccgggactcgccaagcttcatggagccgcggcgcatcaccagcgccgcaagcgtcctattccatactaccggcccagcccctcttcctcctccagctgcttgagcagcgactactcgacccggagccacagccgcagccccagccccggccacagccacgggagctacagcagtcgcagccatgggacccgcagccggacacgcagcccctcgaggacccccagtcccagctaccacagccggagcagctctgagagcgggggcttctgagcccagacagactcagcttggtgcccccctggcactgggagaggcgaggggcgggccccaggaccccagtggggagggggctatatctccttgcccccaaggctacaaagaggtctcagggccagtgcacgggcagatgggaccggggaagactttgagggtgggcatccagtggacaaggagaagccagatgtgctgcttctacgggtgtcctctcccacctcctgtccacccactgtgcccggggaacaaagagccgttacgaacacaggaatctccccatcccccttcctgctgatgccaactcaccaggcttgggactgctgccggtggatggtaccagagtccatgatctgctctgtcacttcaccttagctcagtgcagccagggacaccttgcaaggtgccagccctgggagcccctcttccgcactacacagctccctccactcctctcttatcactgggcagacgaggaggtggtacagcacatgggtttggagctagacagaaggaagaacagcctaacccttggtgcacccccatccaagctggggagctgcatccttttgagctggctgcaggaggaccctggctgagggctggtggctggccccacagcctcccccaagctcctccactgacccaggagtgcccagacgggtggcccccaaaatcccagcctggggagctaggcacctcactcttggtctgacctctccaggccaggctctcctcaccccatgccctgggccaaggtcctaccagccatgactactgcatgacaagaggtggggggtacagacctcaggtacatttgaccctgaggttaaaaggggttcaggtcaagaggtgggagaggaaaggggtagatgggaggtggaatctgtaggaaagagaaaaagcaaagtcgttcactgactgagtagcccccagggagtggagacgggtccctggggagggagcagctgacaggtcagcagtgcccccagccccacccaagaggagggcagcgtgtgcctgtggtctgggacgtgggctggatggcagcccagggtcacaggcataggataacatgtgctttggacctgacaagggagtaccttgggggtctgatggggtcatggccagccgagcctctgtagagatggaggctacagccctcagaagggaggggaggaaagagactgagggccctggcctggggcgtcgatggggaagcggtggcccccagtcctcttctgctgctcccagccccctcctcctggggccctcagggatctcatgaagtcttccttggcccaaccaggcagatgccccgggctccagtggggggaggggtctggggtctggtccgggttccccgctttctctatgtcccccctccctctttctccgcagtgcggataaaaattggactcgaataaaacccttggtgcccggatggtaggtggtgagaccaggcctctgtgcatgttggcaccccgggagattcaggagggcagcggggctggggtcttcctctgagggaggcgaaaggctcagactgctccttgggaccccagagagaagagctggcatccaggagccagtgtgtctatccccctgcctctgagcttgaggctaaaacagggacccaaagagaccttcctcccagcctggaggccgggtggactttgaacatcccacggggtgggctgcctgagcccacacacccaggctaccttcagcagtgggtagggatggggtagagggaggagacacagggtggacataggcacaggggacactcacaacatggtggggtgtcacagagtggttgggacacagcctgaggcagcatgcaggcatgcatcctggctcctgtgcctcccagccatgtgacacacagctgagatgaggtgggcaggaaatattctgacagtcctcagctcagtgactgtgactgccatagagtgagcatttaaaaggtggccacagccgggcgcggtggctcgcgcctgtaatcccagcactttgggaggctgaggcggacggatcacctgaggtcaggagttcgagaccagcctgaccaacatggtgaaaccccgtctctactgaaaatacaaaaattagccgagtgtggtggtgggcacctataatcccaggtactcaggaggctgaggcaggagaatcgcttgaacccgggaggcaaaggttgcagtgagccgagatcgagccactgtactcctgcctgggcaacagagtgagactctgtctcaaaaaagaaagaaaagaaagaagaggaaggaaagaaaaaggaaaggaaggaaggaaagaaaagaaaagaggccaggcgcggtggctcacccctgtaatcccagcactttgggaggccgaggcaggcggatcacgaggtcaggagatcaagaccgtcctggctaacatggtgaaaacccatctctactaaaaatacaaaaaattagctgggcataatggcaggcacctgtagtcccagctactagggaggctgaggcaggagaacggcgtgaacccgggaggcggagcttgcagtgagctgagattgcaccactgcactccagcctgggcaacagagcgagactccgtctcaaaaaaaaaaacaaaaaaacaaaaaaacaaaggaaagaaagaaaaaaaacaaagaaaagaaagagaaaagaaaggaaagaaatggtggccacttagggaaaaccccgtgcctgcctctggctagggactagcagggtgcctggaaagagtggtttacagaagttaatttcctttttatttatttatttattaaaaatgtg

SEQ ID NO: 465844 - DNA, 3148 bp, Homo sapiens
gtgtctctaaggccagggctcaggggaaactgaggcaggaagccctggccgctgctgggatggggctcggggcctgggatggcctgtaatcagctttttcttcccggcagcgccgcaagcgtcctattccatactaccggcccagcccctcttcctcctccagctgcttgagcagcgactactcgacccggagccacagccgcagccccagccccggccacagccacgggagctacagcagtcgcagccatgggacccgcagccggacacgcagcccctcgaggacccccagtcccagctaccacagccggagcagctctgagagcgggggcttctgagcccagacagactcagcttggtgcccccctggcactgggagaggcgaggggcgggccccaggaccccagtggggagggggctatatctccttgcccccaaggctacaaagaggtctcagggccagtgcacgggcagatgggaccggggaagactttgagggtgggcatccagtggacaaggagaagccagatgtgctgcttctacgggtgtcctctcccacctcctgtccacccactgtgcccggggaacaaagagccgttacgaacacaggaatctccccatcccccttcctgctgatgccaactcaccaggcttgggactgctgccggtggatggtaccagagtccatgatctgctctgtcacttcaccttagctcagtgcagccagggacaccttgcaaggtgccagccctgggagcccctcttccgcactacacagctccctccactcctctcttatcactgggcagacgaggaggtggtacagcacatgggtttggagctagacagaaggaagaacagcctaacccttggtgcacccccatccaagctggggagctgcatccttttgagctggctgcaggaggaccctggctgagggctggtggctggccccacagcctcccccaagctcctccactgacccaggagtgcccagacgggtggcccccaaaatcccagcctggggagctaggcacctcactcttggtctgacctctccaggccaggctctcctcaccccatgccctgggccaaggtcctaccagccatgactactgcatgacaagaggtggggggtacagacctcaggtacatttgaccctgaggttaaaaggggttcaggtcaagaggtgggagaggaaaggggtagatgggaggtggaatctgtaggaaagagaaaaagcaaagtcgttcactgactgagtagcccccagggagtggagacgggtccctggggagggagcagctgacaggtcagcagtgcccccagccccacccaagaggagggcagcgtgtgcctgtggtctgggacgtgggctggatggcagcccagggtcacaggcataggataacatgtgctttggacctgacaagggagtaccttgggggtctgatggggtcatggccagccgagcctctgtagagatggaggctacagccctcagaagggaggggaggaaagagactgagggccctggcctggggcgtcgatggggaagcggtggcccccagtcctcttctgctgctcccagccccctcctcctggggccctcagggatctcatgaagtcttccttggcccaaccaggcagatgccccgggctccagtggggggaggggtctggggtctggtccgggttccccgctttctctatgtcccccctccctctttctccgcagtgcggataaaaattggactcgaataaaacccttggtgcccggatggtaggtggtgagaccaggcctctgtgcatgttggcaccccgggagattcaggagggcagcggggctggggtcttcctctgagggaggcgaaaggctcagactgctccttgggaccccagagagaagagctggcatccaggagccagtgtgtctatccccctgcctctgagcttgaggctaaaacagggacccaaagagaccttcctcccagcctggaggccgggtggactttgaacatcccacggggtgggctgcctgagcccacacacccaggctaccttcagcagtgggtagggatggggtagagggaggagacacagggtggacataggcacaggggacactcacaacatggtggggtgtcacagagtggttgggacacagcctgaggcagcatgcaggcatgcatcctggctcctgtgcctcccagccatgtgacacacagctgagatgaggtgggcaggaaatattctgacagtcctcagctcagtgactgtgactgccatagagtgagcatttaaaaggtggccacagccgggcgcggtggctcgcgcctgtaatcccagcactttgggaggctgaggcggacggatcacctgaggtcaggagttcgagaccagcctgaccaacatggtgaaaccccgtctctactgaaaatacaaaaattagccgagtgtggtggtgggcacctataatcccaggtactcaggaggctgaggcaggagaatcgcttgaacccgggaggcaaaggttgcagtgagccgagatcgagccactgtactcctgcctgggcaacagagtgagactctgtctcaaaaaagaaagaaaagaaagaagaggaaggaaagaaaaaggaaaggaaggaaggaaagaaaagaaaagaggccaggcgcggtggctcacccctgtaatcccagcactttgggaggccgaggcaggcggatcacgaggtcaggagatcaagaccgtcctggctaacatggtgaaaacccatctctactaaaaatacaaaaaattagctgggcataatggcaggcacctgtagtcccagctactagggaggctgaggcaggagaacggcgtgaacccgggaggcggagcttgcagtgagctgagattgcaccactgcactccagcctgggcaacagagcgagactccgtctcaaaaaaaaaaacaaaaaaacaaaaaaacaaaggaaagaaagaaaaaaaacaaagaaaagaaagagaaaagaaaggaaagaaatggtggccacttagggaaaaccccgtgcctgcctctggctagggactagcagggtgcctggaaagagtggtttacagaagttaatttcctttttatttatttatttattaaaaatgtg

SEQ ID NO: 465845 - DNA, 3122 bp, Homo sapiens
tcaaggtccagcctgctgagtggcctgtggtcagcctgggggccaggcggacccctctgcacaggctgcctgggagatgcccaacgccgcaagcgtcctattccatactaccggcccagcccctcttcctcctccagctgcttgagcagcgactactcgacccggagccacagccgcagccccagccccggccacagccacgggagctacagcagtcgcagccatgggacccgcagccggacacgcagcccctcgaggacccccagtcccagctaccacagccggagcagctctgagagcgggggcttctgagcccagacagactcagcttggtgcccccctggcactgggagaggcgaggggcgggccccaggaccccagtggggagggggctatatctccttgcccccaaggctacaaagaggtctcagggccagtgcacgggcagatgggaccggggaagactttgagggtgggcatccagtggacaaggagaagccagatgtgctgcttctacgggtgtcctctcccacctcctgtccacccactgtgcccggggaacaaagagccgttacgaacacaggaatctccccatcccccttcctgctgatgccaactcaccaggcttgggactgctgccggtggatggtaccagagtccatgatctgctctgtcacttcaccttagctcagtgcagccagggacaccttgcaaggtgccagccctgggagcccctcttccgcactacacagctccctccactcctctcttatcactgggcagacgaggaggtggtacagcacatgggtttggagctagacagaaggaagaacagcctaacccttggtgcacccccatccaagctggggagctgcatccttttgagctggctgcaggaggaccctggctgagggctggtggctggccccacagcctcccccaagctcctccactgacccaggagtgcccagacgggtggcccccaaaatcccagcctggggagctaggcacctcactcttggtctgacctctccaggccaggctctcctcaccccatgccctgggccaaggtcctaccagccatgactactgcatgacaagaggtggggggtacagacctcaggtacatttgaccctgaggttaaaaggggttcaggtcaagaggtgggagaggaaaggggtagatgggaggtggaatctgtaggaaagagaaaaagcaaagtcgttcactgactgagtagcccccagggagtggagacgggtccctggggagggagcagctgacaggtcagcagtgcccccagccccacccaagaggagggcagcgtgtgcctgtggtctgggacgtgggctggatggcagcccagggtcacaggcataggataacatgtgctttggacctgacaagggagtaccttgggggtctgatggggtcatggccagccgagcctctgtagagatggaggctacagccctcagaagggaggggaggaaagagactgagggccctggcctggggcgtcgatggggaagcggtggcccccagtcctcttctgctgctcccagccccctcctcctggggccctcagggatctcatgaagtcttccttggcccaaccaggcagatgccccgggctccagtggggggaggggtctggggtctggtccgggttccccgctttctctatgtcccccctccctctttctccgcagtgcggataaaaattggactcgaataaaacccttggtgcccggatggtaggtggtgagaccaggcctctgtgcatgttggcaccccgggagattcaggagggcagcggggctggggtcttcctctgagggaggcgaaaggctcagactgctccttgggaccccagagagaagagctggcatccaggagccagtgtgtctatccccctgcctctgagcttgaggctaaaacagggacccaaagagaccttcctcccagcctggaggccgggtggactttgaacatcccacggggtgggctgcctgagcccacacacccaggctaccttcagcagtgggtagggatggggtagagggaggagacacagggtggacataggcacaggggacactcacaacatggtggggtgtcacagagtggttgggacacagcctgaggcagcatgcaggcatgcatcctggctcctgtgcctcccagccatgtgacacacagctgagatgaggtgggcaggaaatattctgacagtcctcagctcagtgactgtgactgccatagagtgagcatttaaaaggtggccacagccgggcgcggtggctcgcgcctgtaatcccagcactttgggaggctgaggcggacggatcacctgaggtcaggagttcgagaccagcctgaccaacatggtgaaaccccgtctctactgaaaatacaaaaattagccgagtgtggtggtgggcacctataatcccaggtactcaggaggctgaggcaggagaatcgcttgaacccgggaggcaaaggttgcagtgagccgagatcgagccactgtactcctgcctgggcaacagagtgagactctgtctcaaaaaagaaagaaaagaaagaagaggaaggaaagaaaaaggaaaggaaggaaggaaagaaaagaaaagaggccaggcgcggtggctcacccctgtaatcccagcactttgggaggccgaggcaggcggatcacgaggtcaggagatcaagaccgtcctggctaacatggtgaaaacccatctctactaaaaatacaaaaaattagctgggcataatggcaggcacctgtagtcccagctactagggaggctgaggcaggagaacggcgtgaacccgggaggcggagcttgcagtgagctgagattgcaccactgcactccagcctgggcaacagagcgagactccgtctcaaaaaaaaaaacaaaaaaacaaaaaaacaaaggaaagaaagaaaaaaaacaaagaaaagaaagagaaaagaaaggaaagaaatggtggccacttagggaaaaccccgtgcctgcctctggctagggactagcagggtgcctggaaagagtggtttacagaagttaatttcctttttatttatttatttattaaaaatgtg

SEQ ID NO: 465846 - DNA, 2657 bp, Homo sapiens
ctggggaattccctgtaagccctgttacaggggctgcaccccagatacaacctgacctgtgtccaaggcgggcaactcaacccttagatattgaatgggtcccatggcaccaatgcttaaacaccagcagccctcacaaccacagatcgtgttttaaggatgaggaggtagttctctggatgcacaggcttcaatccaaatgggctcatgacgccgcagcacacacccagactgcagcctgaagagttggagcattgcattcacagaaagcatccagacatgatcatgggctcagggatacacctgttctccgatgtgtaccagtgaaggatggaaactcctatgcctcccagaaagcaccactcaagcttttgctgaatgcttctctgaaggcccacaaggcctgagaggctgtgcaacaccagcagtaaagtgaatgcccagactcccacctcctttcttgggtggccatctggaaaggccactcccaccctgatggctaatgcctcagaccagttcttggcccagatgatcctagacaattgtttaagcttaaactgttcattggccaagcaaacaggtgatagtcacctctggggaaccacatgccgcgtgtacatccagtactcaggagaacccaaaaatgtctgttccacatagcaacagaagcccaggtagcactcattctcacctgggtgttctccaacatcccagctcagccaaatggctttcattgctttttatggttagaccccaggtcctcgggacactgctttagaaacacattccaaatcctcctctgtgtgtaggtggcattcctatcccaatctctttgcagggtgtatactatgatacgcagccaggctgtcccagaggctttaaatattcccttggtgcaggtagttcagcttagccacagccaatgcatcacagggtcaactgtgttaggagccattgagaatccatagttggttgctgcctgggcctggccagggctgaccaaggtagatgagaggttcctctgtggagttctactttaacctcaccttcccaccaaatttctcaactgtccttgccaccacaattatttaatggacccaacagaaagtaaccccggaaattaggacacctcatcccaaaagacctttaaataggggaagtccacttgtgcacggctgctccttgctatagaagacctgggacagaggactgctgtctgccctctctggtcaccctgcctagctagaggatctgtaagtactacaaaacttaaactttacactgagttttcattattgaagctatgcctccaatctgacctctgactgtggggccaccccagagggaaccagcgggcgaatccctgctaggaacgtctgtccggacctctggtgactgctggggacgatggcttccagctaacttaatagagaaactcaagcagtttccttctaaacacacatgtcctggttgacatgtccagtagagactatcacaggtctttggaacattcttttgagagaaacctatttaggtccttggtctgtttttcaatcaggttgtttgatttttgctattgagttgttggaattccttatgtattcagatatttgccccttcggccatgtaggttttgcaaatattttctctcattttctgggttatcttttcactcggttgattgtttcctttgctgtgcagatgctttagcgttaaatgaagccacacttgtctattttcccttttattgcctgtgcctttggtgtcatagccaagaaatcattacctacatcaatgtcaaaagctttatccttctatacacttctagtagtttatggtttcagttgttacatttaggttttcaattcattctgagttgatgtttctacatggtgtgagataaagatttaaatacatacatatataaaatcatgaggtagtgtacactataaatatacaattgttaattgttactcaagtctaagtagaggtggaaataataaactttcttttttttacttaaaccactctgtgtcactgagctgatttcacctttagcctgataaaatcattgtcctctccaccctgattcctacaggagactactcaccccataacctcaaaaacctcttcatgaggatgacctccagagaacagcaggacccatcttcagaaaataagaagcatttgttccctgagcctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatctcaaataaatgccttgttacaagatttctgtgtttccacctctttaatgtgtgatatgtgt

SEQ ID NO: 465847 - DNA, 1724 bp, Homo sapiens
cgacgatgtgtggttctggatagaatcttgttctgccaacagacaccaactatgatatctgcagtccttactgcaactcgttacgcaaagtttgcaaagagatccaaccacacgttcgcacagagaggcggccttcacgcatacttcataccccttccctttgtctaccacttgtatgtgctcatgatgccagaacttctcaatgggaatagcctgtttgcacaaaactgtgtggggatgcagggcaagtgttgtgcacggggcctgctgctggggacagcacctgccactggggcctcgtgcgttcgtcatcagctgttgcgattggcccagcatctagatagtatctggaaaattgaatgtgacccttttccacaccttgtaacggagcttcccttggaggtggacaaacttctcactcacaagaattcatgtcttcctgattacgttgctatcatcgatgtgtttgagcccattgatgccgacggcatctgtcggatggaaggaagcaccgtgcaaggctcttccttctgcacagcctcttcccagttttgcgagagacagagagcaacagagagagatgggcagggattgattcgaggattggctgactcgattatggagggtgagaagtcccaggacaggccgtctgcaaggcgtaaacccagggaagctgctggtatggctcggttcaagtccaaaggcctcagcaccaaggaaaccaaggtgataactctcatcacgtatattgtaaattacacggaaacctaccgagtagaaagatctcatattgaacctcatttacatggagatcagttatcagagattacagaaaagagccgctggccagtgagtaagtctcacaagatccgatggttttataaagggcagttcccctgcacaagctctcttctctgccaccacgcgtttgctgttcattcacctttcaccatgattgtgaggcctcccagccatgtggaactgtgcagactgaaagcttacaactgttacattaaatccagatggattggtttctttgcaataatcgtaactcgtctcttcctcccacgtttttaatattaagaaggtgtctatacaaatgcccttagccacatttatggtggtttctgaagaggaaaagtgttccatgaaagatgctggcccagagttatcaactggaaatcagtccaagaaaagatagttttctgtgttaataattttttctcagtgcgattgaattcttgcaatggttacacacagatgactttgattgatttgaaacattctctcctcttcttcccctcctcctccaactccttctcctttcatcctttcttggattcttgtgagagccttcttctgggacaattcccattctagttccagcctcagcacacctgtctggtattaggctgtgattgttctcatcattgaaaaaatagggaaactgagttatcaaagatcttattggttgaattgctctgaatatcagactgcctagcccaacacaggtaaaagagagtatcttatgtaataacagagtcaggtttctgatgataaaatgaagccacaatttcattaatatacaaaatgataatgagtgagtaaccaaaagccctccaaagcttacatcctagagtcccaaaatcccagatgccaggactgggcatggcatgttctttcattccttataaacaggtgataggatagaaagtgagcacaga

SEQ ID NO: 465848 - DNA, 3937 bp, Homo sapiens
ggcgccttgttagttatgcaaatttctgcagctggcttgaatttatccccagaaaatggggttttcttttctgttgcatcgtcatgctgcaaaatttccaaacttttatggagatcaagataaaagtaaaacaagcaaggcctggatccatgacactaagagtggctgtgatctatccagtgtctactttgtgcccatcattgcgctgcactcaactggctccgagggcctggaatgcagatgccatgagacagtgactgtttccttctggctcactcctgacttgtcatctaacacagtgctgactccagaacagaagggagtacgtagccttaatattccattccttgctgccatgcccaagagagacacgactaatccatcacagcattcttcccacaaactctgtaagtggccttgtaatcctcctctaattggccattcccaatctgaatcggcacataagatgaagccatacctgaactaatttgcaagataaagctaaacacaagatttgggtgtgcacctggcttgcagcagaactggctgggatggcttcataacttcccttctaacaatataacaatatgcttctgtaaattttcacactgaattggacaagaatcagaatatcctgttttgaacatctgcacagattgacaaacaaaaatggaacatcaagactgactggaaatggtgatgtgaaattcattaaatgctcttgcaattgccagaggtgccaagactgaggctcagagaaatgaaataacatgccaaaggtcacagtgtctagtggagctggggccaaattcaggttcgcgtggtaataaagctttttttatgccatcaccctgcataactgtctgttatgatctttgaaaagtcagattttttcaaaatcacaaaaattctaattttgattgccttacacactcttcctcatcattgtatttttctattggaattaaagtttgcaacctttggagactagaaatctaaggcagcaatttcagatgttttgaagaccctcataaactacaattagtccacaataactagcaagaaacaaacacttctaaaaaaagcatctagtcatttaaaatgatttttaatttcatgactagtatataattatacaagaacagagctatttagttagaaaaaataactttgaagatgagagtccatttagtatttatttgctccaaggttctaattacttcaaaaactactgaaacttcatatatgattactaacagcattcaatagcagctttgatggaagttgaaccaatcttttaaaaattttttagcctcattaacatgagagaaataaaaaataataaataccaggggcacatatatatgatgtcattattactttcccactttgttgccagttcaggtctcccatgctagaaaaatgaaaaataaaacctaacatgtcttcctggtcattttggaattgaggccaacaaaataagaccagtgaagaacaataaacacagtattgtttttctgtaatatattagcaaatcctggtagcttcaattttgtttcattacatttccaatatgtgcatccatcaattcatcttcttttcttcccatagttaagatttatgcactttattaatcacctcaagacagtcatctcagcagtttcatttggtggagtaaaccagtcaaaccccatcagacttctggggatgtcacacagcaaactttggattcctggcaacttgaatcacccttgccaatatgagatttttcagagcaatccatcttagggccaactaatatatcacatctgcctctgctcttttcctaattaataggttcaaagagagacacctgctagatcacacaaatgtccccctgaagcagcctcagcatataggttccttggcagcagcagatcaaaatggcaggcagttaaatgttctattttccaaatgcaagttgaatgatatgaagggtctaggtggcattcagcaaacccacattctccaaagggcttttaaaaacaaaggtaacacattcttcacattcactgcatgctcaggtggtttaaaaatatgatgttgccatgtgtgatggaccaatcatttgtgctggcttctagcttacagcagtgctaaccagaatcagggctgctgacactctacttaagttgttgccacctgttctaattcttggtaactgtattttttgttatcatttttttgatgccaactgcattctccctaaagttctgaaaggacatagttctaaagttagtgtgctcttaattaatttaaaaatatgctttattaagtccccaactgtgcatttgagttacctgccagcttcttttgagatacagagagtaaagacttgggttccaaatgtaactagatcagaaagatctaactacatttccaaatcagaaagaagcaaatttacaaaattattcattcaagagagatatcttctgagcctttttaggtcttgtctgtttctatgatcaaacagaagggtttgggtgtgcacttttcacactaaaagactcaaataaggaagattcaatgacttgtaagcttgcaaaggatcagctaagtaaaaattataaccttatataacagcactgcacataagaccaaaaataaaaaatgccctatttgatattaagaaaatgtaatgaaaaatccagagaggaaaatgggttaccacagtgctatttctatggtctttcaaatgcagtcacacttccaaaatcttgcaattaatggcattaaaaactctccagcctcacaagtttattaagtagcagtgtagttaaacaaaaagggtgctagactagacattgagagatctatactctagccttgactgtgccttaaactgtagtgtgttggtcttgaaccatggaacccaccatacagtaagtgggctggaataaacaatggctacccactggttgccctcaaaggtagcagtgggtctcctcgcactatttttccttcttagaaaaagccaagaaatcatattaacccataatatgattcacaaattagtcaaaacatcacatttatttgctttttgcttaaattacattaactgaaagagttaacactagttatttcatgctaatccattgctcccattcagggatcatgtttctacttagtgataaatcaagttaattactacttaagttcaaattgtaaaggggatcttgcaaaaagtaaaactcatagggaaactaagttctgagtgggaacttggtggtgaccagttaggaaagggttttactaaaatcccttccagttcaggatttctatgactgcaaatatataaatatgaaaaataattagtctttttccagtgtcttttgaatttcagtgtagaactgttttatttactaaatgcatgcctttacaactcttacagagagaacatatacttgcagagagagcattctagccaaactcaccatttccttggctggcctgctcctcgcttcactggcctaattattctcataagcagcttaactgaaatgttggcttacaaatttatatttcaatttaattgtgcccagttcctagtacaatgaaaatgttaaaagtcttttcctattttgacagtgtttcactgtgtttatttttagggacactaacaaataaacttcatgttatctttatacatacaccttttcttttttctttagattaacaacacacaggaaaaaccctcaacttctttcattcgcctgttgagataaagggaaagagagtccccatccaggcctgcaggagagggagaactggtggatgcaaatgaaaaagcagaggcattcctcagggtcttgctctgccacccaggggttggtggctgcagtgagctatgatgacatcactgtactgcagtctgggtaacacagtgagaccctatctc

SEQ ID NO: 465849 - DNA, 557 bp, Homo sapiens
cacgaggctgaccatcatgaccttatggttttgggtgtgcacctggcttgcagcagaactggctgggatggcttcataacttcccttctaacaatataacaatatgcttctgtaaattttcacactgaattggacaagaatcagaatatcctgttttgaacatctgcacagattgacaaacaaaaatggaacatcaagactgactggaaatggtgatgtgaaattcattaaatgctcttgcaattgccagaggtgccaagactgaggctcagagaaatgaaataacatgccaaaggtcacagtgtctagtggagctggggccaaattcagattaacaacacacaggaaaaaccctcaacttctttcattcgcctgttgagataaagggaaagagagtccccatccaggcctgcaggagagggagaactggtggatgcaaatgaaaaagcagaggcattcctcagggtcttgctctgccacccaggggttggtggctgcagtgagctatgatgacatcactgtactgcagtctgggtaacacagtgagaccctatctc

SEQ ID NO: 465850 - DNA, 484 bp, Homo sapiens
cacgaggctgaccatcatgaccttatggttttgggtgtgcacctggcttgcagcagaactggctgggatggcttcataacttcccttctaacaatataacaatatgcttctgtaaattttcacactgaattggacaagaatcagaatatcctgttttgaacatctgcacagattgacaagtgccaagactgaggctcagagaaatgaaataacatgccaaaggtcacagtgtctagtggagctggggccaaattcagattaacaacacacaggaaaaaccctcaacttctttcattcgcctgttgagataaagggaaagagagtccccatccaggcctgcaggagagggagaactggtggatgcaaatgaaaaagcagaggcattcctcagggtcttgctctgccacccaggggttggtggctgcagtgagctatgatgacatcactgtactgcagtctgggtaacacagtgagaccctatctc

SEQ ID NO: 465851 - DNA, 4933 bp, Homo sapiens
gctgaccgtagcttggacgccgctgccgccggggtccaatgccggtcatgcccatcccgcgggggttgtgctccttccatggtccacacaccacctgcctgcatgcggtctgtgggcccgtgggcgcctcccacctggcccgcaccaagtacaacagcttcgagtacttgggcgttagcgtcctcctgtgcttccagcacaagctgtgggtgctgctgctgctgctgggccgctggcgcgtggaattccgcctggtgaacgagctgctcatctacagcatccacgtcaccatgctgctggatgggggcctgggctggtgcctcatggtcttcgctggcttcctgcgcccaccctccccgtgtgcactctcaggggcggcgcccacctgctggtggctcctgctcccacgtcttcaggtcgtactgcggggtgggcctctctccaggaccacagctgccagggactttagacatcaccctgggaggccgctggacacagagggctgtgtgcccaggagcaaatccagacggggggggcccgcctggctgcacagccccttcctgcgtgccctggtcccagccgcagccaacgggacacggaagactcccctccctgacacaccacactgccacaaagctgcttactctgccctgggccgcctgaggcctggcactgcccgcggaccaccctctgtgtctcacctgaggggctgtgtgggttctgaagccccagccagccttcagggtcaccttggattgtgtagatgcagtctagcagggggccggagtggggctcaggtgggaggggtctcagcaggctcccagctcgggctggcctgggggaaccccgggagccaggggccaactccagcaacactggcctgtctgcctgttcctgtagggctgtatgtcctgcagatgctgtggatttctggggaggaacctccattcctttctggctttttttgcgggggaggactttgggcctctttctttgagggaacaccctcaaagaaagcctgggagattgaggctgcagtgagccaggatggggacttgcgcgtccgagtgtccggagcaggcggcagaggcttcagtgtggcaaccacagccccggagcttgtgtggcaccagcagcgtcttaaagcctcggatcttgtccaggaggccagagacgaaggcctctgtgggtgtgtaacagtcaaccagcagctccttgaccctggcagcccaggcatcgtcagtctccatgtccaggagctcatccacatcaatctccagttctgggatctactcttcctggcaaggggctctgaaagtagacgcgtggtcctgggccgccactgcccggcccgggggccagggccgccaacgcagcgcccccgcgcggtgccgctgtccgccttggcggccgccgggaccacgagcacgcgtcgggccgttccctgcgccgccgccttcgggaggccggccggctggctctggttaggtccccggctcctctccatgctgctcggcggcgagggcagcggcgggggcacccgggggcagctgcagcatgcggagcccccgggcagggcctggccgcgccccgctccctccccgccgatccgcctgccctttgtccccgtgaccgccaccccttaacacccagatattctaattcagtacatctgagtgaggtccaggattctatatgtttaacaaacatcccaggtgatttgaatgaagaccagtgtctgagaaccactgcttacaggaatcggagtacttcactggcatctttgagctcttagggtcctaaactacctgctttcttttcacttgtcttagctttctacacttggaattgggtggcttgttcaagtcctggttcttccactttctggctagcagtcttgggcaagtcacttaaattctgcaactatttcctcatctgtacaatgagaacagtgatcactgcccagcctccaacatatttgtgattaaagaaaaaggagataagatagtaattttccattataaagtaccacacattgttaagtttattgcttctttttttccccctgtttcccaagattattgtcttgggtcactggccttttccgtggcaggtcctaaaataggaggagtccttgaccgtgctttccaggtagtactctgaatttacaacagggctattcaaatagtgctcatactccttatcattagggtgtctggatgaaacatacctctgcttctggtttcttaaatagttttgttttatatattgtgctatgatttagctccagcggcgccatgagcaaatgaaaaagaatttggaagcacagcacaaagaattggaggaaaaacgtcgtcagtttgaggatgagaaagcaaactgggaagctcaacaacgtattttagaacaacagaactcttcaagaaccttggaaaagaacaagaagaaagggcagatcttttaaaccctctattgaccaccagttacgtattagttgccaatatgccagcttggacatcagcgttggatccgtttgaccagtttgcactagttttatccataatgatggatttaacagcatgacaaaaattatttttgttgttgttgttcttgatggagattaagatgcctcgaattgtctagggtgttctgtacttagaaagtaacagctctaagtagctttcctacattttcttttttttttttattaaacagatatctttggtttaatgcaaaagaacattttacagttgtacaatcatgttctggtggtttgattttttacaagatattccaaaaaaaaggactctggaaggttttcattgaggataaattgccataatatgatgcaaactgtgcttctctatgataactataatacaaaggttccattcaatgcagcatatacaataatataatttagtctaacacagttgaccctattttttgacatttccattgtttataaatacacatggggaaaaaaaaaccctatatgcttacagtgcacctagaggtttttttttttataacagtctctttttgtttgtttgttttggattctttaaatatatattattctcatttagtgccctccttagccagagtctcattactgcttcatttttgtaataacatttaatttagatattttccatatattggccctgctaaaatagaatacagcatctttcatatggtaggaaccaacaagaaaactttgcattaactccctttttacactttatggtaagtagcagggggaaaatgcatttatagatcatttctaggcaaaatcatttctaggcaaagctaatgaccaacctgtttctacctatatgcagtctctttattttactagaaatgggaatcatggcctcttgaagagaaaaaaagtcaccattctgcgtttagctgtattcatatattgcatttctgtatgttttgtttgtattgtaaaaaattcacataataagccatgtagtgatgtaatagagtgtgggggcttcaatattccacagtcgatgtacaagagtagaattaggtatactctcaagtccctggaaactgaattttttaactggaaagagagtggtgtaatttctcaagatcaaatgatgtagattttaacataatacataatttaagtgtaattaatgtagcccagtttattatcttgaaatgttttaccctatttactttttaaattaatgacctaagcagagggaataattataagtcaatatcagagattgttgtttgggtgttttttatttatttttttcagtgtttgtgttgagagattgggttaacacctctagccaaaaatgtttggttttagggaggctaagaacaacctactgaatttggagaatgcaaaggtaaaaaatttatacagactgcctgcctaactgattaagtactactgcttctgggaaatattatttcaaaattgtatatattataataacagatttctaagacgcattcattattctaccatcctaatgaaaacttcagaagtttttatccatggcatgcccagggtgtcacctgaatctgatgtaggatctatataactttactaggtctttttattgttgactccagtcttaagtatattagaaggctcgttttgctatttggtctgtggatttctgaaaggatcattcacaatacatgtaaaattcaggtaggcctaaggaaaggccagcctgtagaaagcaaaacggcagtgtctgttctccactgtcagaggcattatgtaattgaagtatcctgttagccactgtctttctgctaataaagtggggctgaacaagttagcactaataataccagtgaaccacttgggcaccttgtgggtaaagttttgctgccacctagtggaatgggatatcattgcttccttatcaggttcagaagcaagttgtgaagttgctaataaaatggacacagagcttctttctgtgtagctcaggctgtaatcttgaaagctgaggagatacagacccatgcctctcacactcattagctgggtgtcaccactaccacctgcacattctgacccaccacatcttaatatgttctgtcctcttggagaaattaatctaggagtagaagtcagaatatggtaggtgaggggaagaaaggaaagatggcttgatagccatgaatgcatcaggagcaaaatgttgactcagaaagttatctagatcacagcctccaaacctgatgttgtttccttatgaaaatatttttgagtgtccatagttatatgtattgatatcggggaaactgccccaatattcatgtaggttcttttctattttccctaagcattggccagcttcagaaataaagggacagagtacaaaagagagaaattttcaagccgggcgtcagggggagacatcgcatgtcagtaggttcc

SEQ ID NO: 465852 - DNA, 2713 bp, Homo sapiens
aaaaatgatagtagagtatagtacgtgaatgttattatcaaatcttgggtgaatgtgagctagcttccgacggcgccatgagcaaatgaaaaagaatttggaagcacagcacaaagaattggaggaaaaacgtcgtcagtttgaggatgagaaagcaaactgggaagctcaacaacgtattttagaacaacagaactcttcaagaaccttggaaaagaacaagaagaaagggcagatcttttaaaccctctattgaccaccagttacgtattagttgccaatatgccagcttggacatcagcgttggatccgtttgaccagtttgcactagttttatccataatgatggatttaacagcatgacaaaaattatttttgttgttgttgttcttgatggagattaagatgcctcgaattgtctagggtgttctgtacttagaaagtaacagctctaagtagctttcctacattttcttttttttttttattaaacagatatctttggtttaatgcaaaagaacattttacagttgtacaatcatgttctggtggtttgattttttacaagatattccaaaaaaaaggactctggaaggttttcattgaggataaattgccataatatgatgcaaactgtgcttctctatgataactataatacaaaggttccattcaatgcagcatatacaataatataatttagtctaacacagttgaccctattttttgacatttccattgtttataaatacacatggggaaaaaaaaaccctatatgcttacagtgcacctagaggtttttttttttataacagtctctttttgtttgtttgttttggattctttaaatatatattattctcatttagtgccctccttagccagagtctcattactgcttcatttttgtaataacatttaatttagatattttccatatattggccctgctaaaatagaatacagcatctttcatatggtaggaaccaacaagaaaactttgcattaactccctttttacactttatggtaagtagcagggggaaaatgcatttatagatcatttctaggcaaaatcatttctaggcaaagctaatgaccaacctgtttctacctatatgcagtctctttattttactagaaatgggaatcatggcctcttgaagagaaaaaaagtcaccattctgcgtttagctgtattcatatattgcatttctgtatgttttgtttgtattgtaaaaaattcacataataagccatgtagtgatgtaatagagtgtgggggcttcaatattccacagtcgatgtacaagagtagaattaggtatactctcaagtccctggaaactgaattttttaactggaaagagagtggtgtaatttctcaagatcaaatgatgtagattttaacataatacataatttaagtgtaattaatgtagcccagtttattatcttgaaatgttttaccctatttactttttaaattaatgacctaagcagagggaataattataagtcaatatcagagattgttgtttgggtgttttttatttatttttttcagtgtttgtgttgagagattgggttaacacctctagccaaaaatgtttggttttagggaggctaagaacaacctactgaatttggagaatgcaaaggtaaaaaatttatacagactgcctgcctaactgattaagtactactgcttctgggaaatattatttcaaaattgtatatattataataacagatttctaagacgcattcattattctaccatcctaatgaaaacttcagaagtttttatccatggcatgcccagggtgtcacctgaatctgatgtaggatctatataactttactaggtctttttattgttgactccagtcttaagtatattagaaggctcgttttgctatttggtctgtggatttctgaaaggatcattcacaatacatgtaaaattcaggtaggcctaaggaaaggccagcctgtagaaagcaaaacggcagtgtctgttctccactgtcagaggcattatgtaattgaagtatcctgttagccactgtctttctgctaataaagtggggctgaacaagttagcactaataataccagtgaaccacttgggcaccttgtgggtaaagttttgctgccacctagtggaatgggatatcattgcttccttatcaggttcagaagcaagttgtgaagttgctaataaaatggacacagagcttctttctgtgtagctcaggctgtaatcttgaaagctgaggagatacagacccatgcctctcacactcattagctgggtgtcaccactaccacctgcacattctgacccaccacatcttaatatgttctgtcctcttggagaaattaatctaggagtagaagtcagaatatggtaggtgaggggaagaaaggaaagatggcttgatagccatgaatgcatcaggagcaaaatgttgactcagaaagttatctagatcacagcctccaaacctgatgttgtttccttatgaaaatatttttgagtgtccatagttatatgtattgatatcggggaaactgccccaatattcatgtaggttcttttctattttccctaagcattggccagcttcagaaataaagggacagagtacaaaagagagaaattttcaagccgggcgtcagggggagacatcgcatgtcagtaggttcc

SEQ ID NO: 465853 - DNA, 1466 bp, Homo sapiens
cgccgcgggggtgctgggactccggccgcagtgccgccgccatcatggacttcctgtgggacaagcgcacgggcctggccgccagaaagatgcctcatcctcgaagtagtagtgaccggacacgacggcgccggcgagaggacagctaccatgtccggaggaggtgcagccggacatttagccgctcgtcttcgcagcacagcagccggaaagccaagagtgtagaggacgacactgagggccacctcatctaccatgtcggggactggctacaagagcgatatgaaatcgtcagcaccttaggaaaggggaccttcggccgagttgtacaatgtgttgaccatcgcaggcgtggggctcgagttgccctgaagatcattaagaatgtggagaagtataaggaagcagctcgacttgagatcaaagtgctggagaaaatcaacgagaaagaccctggcaagaacctctgtgtccagatgtttgactggttcgactaccatggccacatgtgtatctccttggagcttctgggccttagcaccttcgatttcctcaaagacaacaaccacctgccctaccccatccaccaagtgcaccacatggcctcccagctgtgccaggctgtcaagttcctccatgataacaagctgacacatacagacctcaagcctgaaaatattctgtttgtgaattcagactatgagctcacctacaacctagagaagaagcgacatgagcgcagtgtgaagagcacagctgtgcgggtgggagactttggcagtgccacctttgaccatgagcaccatagcaccattgtctccactcgccattaccgagcaccagaagtcatccttgagttgggttggtcacagccttgtgatgtgtggagtataggctgcatcatctttgagtactatgtgggcttcaccctcttccagacccatgacaacagacagcatctagccacgatggaaaggatcttgggtcctatcccttcccggatgatccgaaagacaagaaaacagaaatatttttaccggggtcgcctggattgggatgagaacacatcagctggacgctatgttcgtgagaactgcaaaccgctgcggcagtatctgacctcagaggcagaggaagaccaccagctcttcgatctgattgaaagcatgctagagtatgaaccagctcagcggctgaccttgggtgaagcccttcagcatcctttcttctcccgcctttgggctgagccacccaacaagttgtgggactccagtcaggatatcagtccgtgaccaccaggccctgggcctccctgcatcttttatagcagtgagtgtccagtccaggacattggtgcttttttataaaagagaacagagccagagttcactccttcctgctgcttctctatatacctgtgaatatgtgaaacagtaaatatgaaagaacttgtacctatcacttca

SEQ ID NO: 465854 - DNA, 2558 bp, Homo sapiens
ccggccggcgggcgggcgacgatgccgaacttctgcgctgccgccaactgcacgcggaagagcacgcacttcccgcgggaccctgccagatgccagaagtgggtggagaactgtaggagagcagacttagaagataaaacacctgatcagctaaataaacattatcgattatgtgccaaacattttgagacctctatgatctgtagaactggtccttataggacagttcttcgagataatgcaataccaacaatatttgatcttaacagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctcaaatatctacttgaaatcttgattctgatgggaaggcaaaacatacctctggacggacatgaggctgatgaaatcccagaaggtctctttactccagataactttcaggcactactggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacgtcttttccattatcactgacgatgtagtggacatagcaggggaagagcacctacctgtgttggtgaggtttgttgatgaatctcataacctaagagaggaatttataggcttcctgccttatgaagctgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctctttctgtgccttaaatatgtggttggcaaaatcagtacctgttatgggagtatctgttgcattaggaacaatcgaggaagtttgttcttttttccatcgatcaccacaactgcttttagaacttgacaacgtaatttctgttctttttcagaacagtaaagaaaggggtaaagaactgaaggaaatctgccattctcagtggacagggaggcatgatgcttttgaaattttagtggaactcctgcaagcacttgttttatgtttagatggtataaatagtgacacaaatattagatggaataactgtatagctggccgagcatttgtactctgcagtgcagtaacagattttgatttcattgttactattgttgttcttaaaaatgtcctatcttttacaagagcctttgggaaaaacctccaggggcaaacctctgatgtcttctttgcagccggtagcttgactgcagtactgcattcactcaacgaagtgatggaaaatattgaagtttataatgaattttggtttgaggaagccacaaatttggcaaccaaacttgatattcaaatgaaactccctgggaaattccgcagagctcaccagggtaacttggaatctcagctaacctttgagagttactataaagaaaccctaagtgtcccaacagtggagcacattattcaggaacttaaagatatattctcagaacagcacctcaaagctcttaaatgcttatctctggtaccctcagtcatgggacaactcaaattcaatactttggaggaacaccatgctgacatgtatagaagtgacttacccaatcctgacacgctgtcagctgagcttcattgttggggaatcaaatggaaacacagggggaaagatatagagcttccgtccaccatctatgaagccctccaactgcctgacatcaagttttttcctaatgtgtatgcattgctgaaggtcctgtgtattcttctgtgatgaaggttgagaatgagcggtatgaaaatggatgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaacaggctttcttatatttgatatttggaagtaaaagccgtaaggtgtatgtaggccacttaatcactaaatatctttgcctataggactccattgaatacattagccattgataatctacctgtttaaatggcccctgtttgaactctcaagctttgaagacctacctgttcttccagaagagaacgttgaaagttccatgtttccttttgcgtgatctctgttgacggcactctggaattgtttcagttaagtcatttt

SEQ ID NO: 465855 - DNA, 2428 bp, Homo sapiens
aggagtggggtcaggaagagtcagctgaaagcgcctgcaacggcgcctggctggcaaacagcggacttgttaattacagcctttcaactaagggcgcctgaaactcgcaaacattttgctcgggtgtggattcgctcccgttagttacaaacttgggatcccgggacccggaaagcaagggggaaaaataaatcgcgatggggccaagggacagctgctgcggcaacttttacccagcggagcccacctacagcctcagcctccgggtctcaggtctccgccgtttcttctcaaggagtcggtcgggggagcggcactgcacagcttttctccaatcagacacctcaaggctggcgcctgatccaatctcctcccctggagggtgggaacgcgaagttcctacctgcacctgtggcagcggtgaccgcctcctgggttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctcgggcccctggtggaaatcgctcaccaacagcagaaagaaaagcaaggaagccgcagtgggggtgccgcctcccgcccagcccgctcccggggagcccacgccacctgcgccgcccagcccggactggaccagcagctcccgggagaaccagcaccccaatctcctcgggggcgccggcgagccccccaaaccagacaagttatacggggacaaatccggcagcagccgccgcaatttgaagatctcgcgctccggccgctttaaggagaagaggaaagtgcgcgccacgctgctcccggaggcgggcaggtccccggaggaggcaggctttcctggtgacccccacgaggacaagcagtagccccaatagcctgcgcgctccaggactgcctacccagcactaccccaaacccccagttccaaacccgagacttcaggcccgcccccttacgcgttgtctcattccaccaaattcagaatatttacacaatgccttcatgattttatttttctggaaattgaagtgtcaattgggttctcaatatttcatgactccaaggatgcattaaatatttatttgtggtaagagaagatacctgccgcggaggagggtggcataattattttttttcaaaaagctattctggggccctggccccctggctcctgtcacagctcagcttgaactctgtagcctctcaaatgaagaaggtggctgttatttaggactctgtggaaagcaaatcacagtgctgtttttaatgcctgagaaatgcactttaggggtagacttataccttaagtgaaggagtgggggaggaagaagcattcttaagtagaagcattttaaaataaggcaggattgcttttaatgttaaactacaaaactgtacagcctattttagtgtggactattaaaacccttgcactgtaaggcttaaggtgacttttgtattttttccattccaagactgaatcccatcatacttaaaagcaggcaggcaaagtccgaggtgagagttaatcatttgccacacaacataacagtgactagtggaaagctgcagggaagagaatatttctggaaaccagcaacacctggactggaacttgttagccagatatccctatttatcagccaaattcgaggaagggagagaggtaccaattcattattcctaaattcaccttttacttcagtgcattttcatagactatagtaagttacaatgctagtaatacatccttttcagtatccattgttaaacttactaac

SEQ ID NO: 465856 - DNA, 1413 bp, Homo sapiens
agtaaaaggaagaattaggatggcggttttcaagggaagttaagtctagacatgcttctttgaaagtcacaaggcagaagtggtcaaaagctagaatttaaaagaaccaaaacaaatatcataagcttgtccttctctcctactgggatataaattctcctaagtatctcatcgaaaaggctcctgggacgaaagtcgatgggggcaaatcttggagggaaatttcgtgacttgtttgaccatggactaattaataccgttcacctgtagagaggatgcacttggttcccagcgccctcctcccagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctcgggcccctggtggaaatcgctcaccaacagcagaaagaaaagcaaggaagccgcagtgggggtgccgcctcccgcccagcccgctcccggggagcccacgccacctgcgccgcccagcccggactggaccagcagctcccgggagaaccagcaccccaatctcctcgggggcgccggcgagccccccaaaccagacaagttatacggggacaaatccggcagcagccgccgcaatttgaagatctcgcgctccggccgctttaaggagaagaggaaagtgcgcgccacgctgctcccggaggcgggcaggtccccggaggaggcaggctttcctggtgacccccacgaggacaagcagtagccccaatagcctgcgcgctccaggactgcctacccagcactaccccaaacccccagttccaaacccgagacttcaggcccgcccccttacgcgttgtctcattccaccaaattcagaatatttacacaatgccttcatgattttatttttctggaaattgaagtgtcaattgggttctcaatatttcatgactccaaggatgcattaaatatttatttgtggtaagagaagatacctgccgcggaggagggtggcataattattttttttcaaaaagctattctggggccctggccccctggctcctgtcacagctcagcttgaactctgtagcctctcaaatgaagaaggtggctgttatttaggactctgtggaaagcaaatcacagtgctgtttttaatgcctgagaaatgcactttaggggtagacttataccttaagtgaaggagtgggggaggaagaagcattcttaagtagaagcattttaaaataaggcaggattgcttttaatgttaaactacaaaactgtacagcctattttagtgtggactattaaaacccttgcactgta

SEQ ID NO: 465857 - DNA, 2085 bp, Homo sapiens
aggagtggggtcaggaagagtcagctgaaagcgcctgcaacggcgcctggctggcaaacagcggacttgttaattacagcctttcaactaagggcgcctgaaactcgcaaacattttgctcgggtgtggattcgctcccgttagttacaaacttgggatcccgggacccggaaagcaagggggaaaaataaatcgcgatggggccaagggacagctgctgcggcaacttttacccagcggagcccacctacagcctcagcctccgggtctcaggtctccgccgtttcttctcaaggagtcggtcgggggagcggcactgcacagcttttctccaatcagacacctcaaggctggcgcctgatccaatctcctcccctggagggtgggaacgcgaagttcctacctgcacctgtggcagcggtgaccgcctcctgggttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctcgggcccctggtggaaatcgctcaccaacagcagaaagaaaagcaaggaagccgcagtgggggtgccgcctcccgcccagcccgctcccggggagcccacgccacctgcgccgcccagcccggactggaccagcagctcccgggagaaccagcaccccaatctcctcgggggcgccggcgagccccccaaaccagacaagttatacggggacaaatccggcagcagccgccgcaatttgaagatctcgcgctccggccgctttaaggagaagaggaaagtgcgcgccacgctgctcccggaggcgggcaggtccccggaggaggcaggctttcctggtgacccccacgaggacaagcagtagccccaatagcctgcgcgctccaggactgcctacccagcactaccccaaacccccagttccaaacccgagacttcaggcccgcccccttacgcgttgtctcattccaccaaattcagaatatttacacaatgccttcatgattttatttttctggaaattgaagtgtcaattgggttctcaatatttcatgactccaaggatgcattaaatatttatttgtggtaagagaagatacctgccgcggaggagggtggcataattattttttttcaaaaagctattctggggccctggccccctggctcctgtcacagctcagcttgaactctgtagcctctcaaatgaagaaggtggctgttatttaggactctgtggaaagcaaatcacagtgctgtttttaatgcctgagaaatgcactttaggggtagacttataccttaagtgaaggagtgggggaggaagaagcattcttaagtagaagcattttaaaataaggcaggattgcttttaatgttaaactacaaaactgtacagcctattttagtgtggactattaaaacccttgcactgta

SEQ ID NO: 465858 - DNA, 2088 bp, Homo sapiens
aggagtggggtcaggaagagtcagctgaaagcgcctgcaacggcgcctggctggcaaacagcggacttgttaattacagcctttcaactaagggcgcctgaaactcgcaaacattttgctcgggtgtggattcgctcccgttagttacaaacttgggatcccgggacccggaaagcaagggggaaaaataaatcgcgatggggccaagggacagctgctgcggcaacttttacccagcggagcccacctacagcctcagcctccgggtctcaggtctccgccgtttcttctcaaggagtcggtcgggggagcggcactgcacagcttttctccaatcagacacctcaaggctggcgcctgatccaatctcctcccctggagggtgggaacgcgaagttcctacctgcacctgtggcagcggtgaccgcctcctgggttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctcgggcccctggtggaaatcgctcaccaacagcagaaagaaaagcaaggaagccgcagtgggggtgccgcctcccgcccagcccgctcccggggagcccacgccacctgcgccgcccagcccggactggaccagcagctcccgggagaaccagcaccccaatctcctcgggggcgccggcgagccccccaaaccagacaagttatacggggacaaatccggcagcagccgccgcaatttgaagatctcgcgctccggccgctttaaggagaagaggaaagtgcgcgccacgctgctcccggaggcgggcaggtccccggaggaggcaggctttcctggtgacccccacgaggacaagcagtagccccaatagcctgcgcgctccaggactgcctacccagcactaccccaaacccccagttccaaacccgagacttcaggcccgcccccttacgcgttgtctcattccaccaaattcagaatatttacacaatgccttcatgattttatttttctggaaattgaagtgtcaattgggttctcaatatttcatgactccaaggatgcattaaatatttatttgtggtaagagaagatacctgccgcggaggagggtggcataattattttttttcaaaaagctattctggggccctggccccctggctcctgtcacagctcagcttgaactctgtagcctctcaaatgaagaaggtggctgttatttaggactctgtggaaagcaaatcacagtgctgtttttaatgcctgagaaatgcactttaggggtagacttataccttaagtgaaggagtgggggaggaagaagcattcttaagtagaagcattttaaaataaggcaggattgctttgatgtaacttaccaaggagcgtgaaataacccgcctttatatgtgctgggatctattaaacacctgc

SEQ ID NO: 465859 - DNA, 1427 bp, Homo sapiens
gaaagcatctgtttggaaccctggaatggatactctgaggccagacaccatgtctttttcaccctttaaggtgcctggcatccgatacaatgcctggaatatagtagacacgggaaagtctgatgatgatgatggtaatgatgacagtgacgataaaaatgatgttgttggtgatattgatgatagtggtaatggtgatgatggctgtggtagtattgatgatgatggtgttaatcatgtttctgctggctatgaattggatgcccttagagtttcaggctcagacccaacctctgcaccctggcctagtttccatagatgtcccccagtgcaagggcccccagtgatccccaacacttcagagcccaagccctgttcagtctccaaaaaaggaaaaagagcctgctcttcctgctccaaaacccctggaccaactcctctcttccttggattaattgatcattgttccttctcttttgatgcccttctcccaaccaggagcaaaagagcagtaggagaaaaacaattctaaccttacataaatgcagttctacaaatagattattttcgcagattctggaaccactgagggaggcatagtcacagatctaaggaattctagaattctggagatgtggccataaatataacaatctagtttccttatttggtgctttttaaactgtcatacccgtgccctgattatgcaaagaggtaccggggacaagaaactataagataagatcccccagagtgacactggtacagaacctaacacaagctaagaaggactagaagaaacaattatcacacatacctagcaagtggatattggtttctaatgccattcaccagtaaaaaaacacacaggactacttggagaaattgactgattctaggactgaggctagaaatactcaagatcagcctggagtttcttatagtgccagaaagtaagaaagtgcttgaaaaaaaagaaccacagagtcccacaataataggagtatgtcaaagacatgaaggagccaactgaaggagctcttaatggccaaaactcgaaaaattggagcaatgaaataaagtaaagcagaattggattataacctaaagtataaaataagtattcataagtctatgccaatagaaatgattgaataaataaatgaggaaaaggggcaaatttcctgtgcagagaaattccagctgatttatgtactcctctctcaagttggagtataacacctaacttcttaagtgtccgttggacttagtgacttccttcaaaactatacagtatgaaaggggaaggaaaaggtaactttacctggaaaaagctgacacatgctacctcagccaggagatcaagttcaacatcaacagtgataagtcatattgatggtatgtacatttatttatgtatttatttg

SEQ ID NO: 465860 - DNA, 743 bp, Homo sapiens
ggaaaaggccaggcgattcaagatggcggaggacctggacgagctcttggatgaagtcgagtccaagttttgcacacctgaccttctaagacggggtatggtcgagcagcccaaaggctgcggcggcggcacccacagtagcgaccggaaccaagccaaggcgaaagagacgctcagatcaacagaaacatttaaaaaagaagatgatcttgacagtcttattaatgaaatacttgaagagcccaacttggacaaaaaaccctctaaattaaaatctaaatcttcaggtaacacatctgtcagagcttccattgaaggccttggtaaaagttgcagtccggtgtaccttggtggaagctctattccatgtgggattggaacaaatatttcatggagagcatgtgaccatcttgcgttgtatagcctgtgatttcttggtagtcagctatgatgactatatgtgggacaaatcgtgtgattatctgtttttcagccaccctactgaagggaggaagatctgatcattagaatccttttcctagccatgacacatttacatacttgtaaaatttattgtacatgattcttacaacaagtaatttgtaaagatgtttgttttatttattccctatgaggaaagcagcaatgcgatcatttatttataactagtgactgtacacatggcgacctttattttatataagttgaagccacaacttttctattaaaaaaaaaaaaaaaga

SEQ ID NO: 465861 - DNA, 2662 bp, Homo sapiens
tgttagccagggccactgggagggggctcacagcgaggcgcccgccgcggctgattgacagcgctgggtgaatgagcgcgcgtggaggcgcccggcaccgaggtggccgcggctccgcgctgctgtgagcgcctgcctgcccgcccgggtgtggggggaccgcgggtggcgggctgggtgggaggaggaggaggaggaggaggagagagggcgcgggagcgagggcgggcggacgggagggccgtcagagccggctgccgcggagccccggcgcgggcggcttcgccggggagcgaggctcggagccaggaggcggcgccgctgggagggagcgcggagtgcggagtgcggagcgcggggcctggccgcccgcctggtgagagcgctgcgggccggggccgggccgggggcggctcaggggcagcggggcggcgaggctgcggtctctggactaggcgaggggccgccgggggctggaggtccggatcttcagtcggggcgctgggcacaacagagagaagcggtgagataccacgaagcgttgcccagctgggcgccagggccgccacgaccgccccttttcggagactcggcgaggagacctgcctgcgggagagaccccggggagcaggaccttcctcctcaaaagctgctgaataactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacgggcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcgggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctaccccagggaccttcatacaagaccaacgagtcttgtcctgtttctgggatgagtggggttactgggagcagccccttgaagactcttctgaatcgttgggaagtggcttttcacagagatgggacatcgccctgggagaaccaggagcacccagatttcctagccaattaagagctctcagctttgggtctgtctgatgagctgacttgagacaaagatcttctgtttctaggaggacatgggttctaggtctctgtgtataagttggatgttatgtttgctttgagtgtgtttga

SEQ ID NO: 465862 - DNA, 2139 bp, Homo sapiens
tgttagccagggccactgggagggggctcacagcgaggcgcccgccgcggctgattgacagcgctgggtgaatgagcgcgcgtggaggcgcccggcaccgaggtggccgcggctccgcgctgctgtgagcgcctgcctgcccgcccgggtgtggggggaccgcgggtggcgggctgggtgggaggaggaggaggaggaggaggagagagggcgcgggagcgagggcgggcggacgggagggccgtcagagccggctgccgcggagccccggcgcgggcggcttcgccggggagcgaggctcggagccaggaggcggcgccgctgggagggagcgcggagtgcggagtgcggagcgcggggcctggccgcccgcctggtgagagcgctgcgggccggggccgggccgggggcggctcaggggcagcggggcggcgaggctgcggtctctggactaggcgaggggccgccgggggctggaggtccggatcttcagtcggggcgctgggcacaacagagagaagcggtgagataccacgaagcgttgcccagctgggcgccagggccgccacgaccgccccttttcggagactcggcgaggagacctgcctgcgggagagaccccggggagcaggaccttcctcctcaaaagctgctgaataactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcgctgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggc

SEQ ID NO: 465863 - DNA, 3120 bp, Homo sapiens
tgttagccagggccactgggagggggctcacagcgaggcgcccgccgcggctgattgacagcgctgggtgaatgagcgcgcgtggaggcgcccggcaccgaggtggccgcggctccgcgctgctgtgagcgcctgcctgcccgcccgggtgtggggggaccgcgggtggcgggctgggtgggaggaggaggaggaggaggaggagagagggcgcgggagcgagggcgggcggacgggagggccgtcagagccggctgccgcggagccccggcgcgggcggcttcgccggggagcgaggctcggagccaggaggcggcgccgctgggagggagcgcggagtgcggagtgcggagcgcggggcctggccgcccgcctggtgagagcgctgcgggccggggccgggccgggggcggctcaggggcagcggggcggcgaggctgcggtctctggactaggcgaggggccgccgggggctggaggtccggatcttcagtcggggcgctgggcacaacagagagaagcggtgagataccacgaagcgttgcccagctgggcgccagggccgccacgaccgccccttttcggagactcggcgaggagacctgcctgcgggagagaccccggggagcaggaccttcctcctcaaaagctgctgaataactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcgctgcccgcccggcgccccctgcctggaagggccctggccctggtgggccttccagctaggcctgcgcctgggcgaggtgggcgtcgcgctcccgttggcgctgctgggcctctacccggcgctctgcagtcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcgggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctaccccagggaccttcatacaagaccaacgagtcttgtcctgtttctgggatgagtggggttactgggagcagccccttgaagactcttctgaatcgttgggaagtggcttttcacagagatgggacatcgccctgggagaaccaggagcacccagatttcctagccaattaagagctctcagctttgggtctgtctgatgagctgacttgagacaaagatcttctgtttctaggaggacatgggttctaggtctctgtgtataagttggatgttatgtttgctttgagtgtgtttga

SEQ ID NO: 465864 - DNA, 2426 bp, Homo sapiens
tgttagccagggccactgggagggggctcacagcgaggcgcccgccgcggctgattgacagcgctgggtgaatgagcgcgcgtggaggcgcccggcaccgaggtggccgcggctccgcgctgctgtgagcgcctgcctgcccgcccgggtgtggggggaccgcgggtggcgggctgggtgggaggaggaggaggaggaggaggagagagggcgcgggagcgagggcgggcggacgggagggccgtcagagccggctgccgcggagccccggcgcgggcggcttcgccggggagcgaggctcggagccaggaggcggcgccgctgggagggagcgcggagtgcggagtgcggagcgcggggcctggccgcccgcctggtgagagcgctgcgggccggggccgggccgggggcggctcaggggcagcggggcggcgaggctgcggtctctggactaggcgaggggccgccgggggctggaggtccggatcttcagtcggggcgctgggcacaacagagagaagcggtgagataccacgaagcgttgcccagctgggcgccagggccgccacgaccgccccttttcggagactcggcgaggagacctgcctgcgggagagaccccggggagcaggaccttcctcctcaaaagctgctgaataactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacgggcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggctcagaagcagccagctccggctcaggactacagcctgtccaacctctgggatccagagctggtctgaatgaagcgagagctgcgagacagtcggaaccgccgaaaatgaagtgggggggggaccaacggaagggccctgccggaagcctggcgcgccacggaggacccccggagaccacccagccggggggggacaggacatccgcggcaagggcaagagcccggtacgggcaagcgcaggc

SEQ ID NO: 465865 - DNA, 2304 bp, Homo sapiens
caggtatggggtggttttagggcccgcacctcacagtcctgccgcctcaggtcccacaaccacagaaccagaggattcgatggccctgcttcaactcttccgagggtgctgggggctgcctggggtggaggaagcgaatcaacaggacgtcccctacgcaacttaatggaccctccctgagggctgggactatctgtcctgttcacagctgtgtagggaccagccccacagggtcggtggatctctccctgtttgcggcgatgagagagtgtagaaagaaagacacaagacaaagagacaagagaaaaggcagctgggcccgggggaccactaccaccaatgtgcggagaccggtagtggccccgaatgccctccacaagaagtggaggagcagagtcttctctaaactcccccggggaaagggagactccctttcccggtctgctaagcagccggtgtttttccttgacactgaggctactgctagaccaccgtccgctcggcaacaggcgtcttcccagacactggcgattctggaatacctgtcccaacgccctgagcctgctcccagctctgtgagaacctccttcctggctccatctgctccaaagaagactgtgcggcaagtcatgcaccctaggcctgagggtggacagcaaggtgctgtctgcaagctggtgtggagggattgggctgacctgtccatatacatgctcatggaccatttcatggcttcatgacactgtttaatattatgtagaataagacccttccattactctagtttttaaaaactttctagctattcagattatgattttactttctgatgaatttcagagttatttagacaagtttttaaaatctcacaggagtattaaatacagactcactgctttgtcctacgtgaggacaaacccagctgcttcatagcctctgggtttatgtatctgctcaagctaaccagcccaatctgagaccaatgcattagtcacaattccaagctccaaggagaatgaatctgattgccttcatcaggttacctactgtggggaggtcattgtcatgtaatagaaaggcagctcccaggagattattgagggctgaaaatatacccctaaaggtatctattatcagattgagcatgtccctccaaaattctgtgcctttgtacagtagctccctctgttgtgacagcagtgtggctgtgatgatgggagtggctcagacaacaagaaaaggttttaagtatttcccaagccaccagcattagacagttggttcagctcaccagttgaaatatctggtatgtgtcagataccctccgaggctctgaagagattggtgtaacccagatacattttggggccccatgtggcttagtttaggtatggagacacatttaaaaacacacagtcccaaaataattaaacttaattaaaactaaattataatttttcttttgcatagtttttctttttttgaaggagtctaactctgtcacctaggctggagtgcagtggagcaattgcggctcactgcagcctcaacttcctgggctcaagcaatcctcccacctcagcctcatgagtagcttggactacaggcgattgtcagcactgttgcccgggtgctgttctgcccactgtttggagactttccaccctcgtgactgcctagagagagcccttctctgagctgagctgctgaacattctggaagacgtgtgctctgatgagtggagaaagtggagtagggcaaattgcattctaggtggagctgtcaaaaggcatccatccattcatatgtttattcatggtccctttgggttctcagatttttcagatcagctgcttggcagcttgcactttgatgttgcagtggaggctctgttcaggcttctgccccataagaaaaatcaaagcttcattccctgccgatgcattgactgggacatcatccaggtccctggggcaggaatgttattagacactcaataaatatttgttgaatcttgaatgaatttacctcctgaaacctgctcagagacagtgaatggacagagggacagctttcagtctggccaacaattaatacttatgcaaatgtatttagaactgctaatcaggaggttatggtcactcattcattcattcatttgttcactcagcaaatgtttattgagcatctactaggtactggttgctgctccaaacactgaaatgagtcagtggaaatgggaaaggccttcctgttggtgggagaacaatgaatgaaaatcaaacgaacagggcaattacttat

SEQ ID NO: 465866 - DNA, 911 bp, Homo sapiens
ctcgtacatcctgtgagttgaagcaaacgcagaatgagatgcgcccaccatgacagcatcgtacagggcagtttcaccgtcgtgcaaatcctctgggctccacctgctcctcccagtcctcggcatcatacagggcagtttcaccgtcctgcaagtcctctgggctccacctgctcctcccagtcctcggcatcgtacggggcggtttcaccgtcctgcaagtcctctgggctccacctgctcctcccagtccttggcatcgtacggggcggtttcactgtcctgcaagtcctctgggctccacctgctccttccagtcctcggcatcacaggctttctgagccggcctggaaatggaatcaccacacagaatattacgtctgtgggaagatgtgttcagagtcaatggagatctgacctgtggggctggaaggtgatttgtgggatgacgaggacctgcctgctgagatcctggtgcgcagctccattataaggtgtgtgaaaaccagagaccacgcagctctcaggaacacaaatgcgtggagaacaaatgcccagtgagagaccaccactatacaaacacgaacgagacccccagaaatggcacccaggaacccacgtctggcttcatagacttatgtgtttactggggaaccgaatggacccgcccacatgtgctgcacccaggcggcctcttctggcatctctcagtgggatgtgctgcacccaggcggcctcttccggcatctctcggtgggatgtgctgcacccaggcggcctcttcccgcatctctcggtgggatgtgctgcacccaggcggcctcttcccgcatctctcggtgggatgtgctgcacccaggcggcctcttcccgcatctctcggtgggatgtgctgcacccaggcggcctct

SEQ ID NO: 465867 - DNA, 863 bp, Homo sapiens
ggaaaactgcctactcaagcctcagtaatggtggacacccctccccacaccaagcttggtagtcccacattgacttcagactgctgtgctggcaatgagaatttcaagccagtagttcttaacttgctgggctccgtaggagtgccacccactgagcgagaccacttggctccctggcttcagccccctctccaggggagtgaatgcttctgtctcactgggattccaggcaccactgggctggccaccccagcccgcagcggcaaccctcttgggtccacttcaatgctgtggaagctttgttcttttgctcttcacaataaatcttgctgctgctcactctttgggtccatgccatctttaagagctgtaacactcaccgcgaaggtccggggctccattcttgaagtcagcaagaccatgaacccaccagaaggaaccaactctggacatatcttggcaacccagatgggactatctccaagcacatgaattacatgcataaatactggacctccagcgatcatcttgagggtgtgaaaagagcttgcagatgcaaactacataataagaaaacacaacagaaagatgtaaggagccatggtcaattaggtcatcgtgataccacattacaatgctgggctgcttatcactgcaattttattatgaagaggagaaaaaaataaattttattgaagttgtttcattgtatctctgttattgtatcagccaaattgattttctagcagatacaagatatgtagtgtataccagttgttgtctttctataacagtaattttcctttggtggaaaagtttgcttccactatgcatgattttaataaatataatctttctttgga

SEQ ID NO: 465868 - DNA, 508 bp, Homo sapiens
taatttttcctggaattggtgccaatttactcatgaaaggataactatacgaatccttcctacccatcccctgtagtggaatgcattcgctctaaatcatgatgttcctgccaaaaaatatatttttctgagcatgaattacatgcataaatactggacctccagcgatcatcttgagggtgtgaaaagagcttgcagatgcaaactacataataagaaaacacaacagaaagatgtaaggagccatggtcaattaggtcatcgtgataccacattacaatgctgggctgcttatcactgcaattttattatgaagaggagaaaaaaataaattttattgaagttgtttcattgtatctctgttattgtatcagccaaattgattttctagcagatacaagatatgtagtgtataccagttgttgtctttctataacagtaattttcctttggtggaaaagtttgcttccactatgcatgattttaataaatataatctttctttgga

SEQ ID NO: 465869 - DNA, 1335 bp, Homo sapiens
ggctccctgaccctctcaacgaatgccctccaaaaagcccaggaagcaaaatccattattcatcgaaagtataagtgaacaggcagaagtctccaaaaacaatgccttacagctgagggaaaaactgggaaatataagaaaccaaagtgactctgaagaagaaaacatcaatcttttcatcaaaaaagtgaaaaactttttgttagaggaaaacgtgcctccagaagacatcgagaaggttgcgaatggtgtgcttgacattcacctaccaattccatcccaaaatctaaccgatgaacttgtcaaaatacagaaacatatgcaactctgtgaggattacaggacagatgaaaacaggttaaatgaagaagcagatggagcccaaaagcttttggtgaaggccaaagcagctgagaaagcagcaaatattctattaaatcttgacaaaacattgaaccagttacaacaagctcaaatcactcaaggacgggcaaactctaccattacacagctgactgccaatataacaaaaataaaaaagaatgtgctgcaggaatttgttgagctgaaaaaacaatatgctattctccaacgtaagacaagcactacaggactaacaaaggagacattaggaaaagttaaacagctaaaagatgcggcagaaaaattggctggagatacagaggccaagataagaagaataacagatttagaaaggaaaatccaagatttgaatctaagtagacaagcaaaagctgatcaactgagaatattggaagatcaagttgttgccattaaaaatgaaattgttgaacaagaaaaaaaatatgctaggtgctatagctaggcagagttaaagagcaaaagcttgtgcctttgtttctggtttctgatgtacaagcccctggggctctgttgaacctgtgaaatactgacaatgtcttctaccttccttccccacaccctgtccttattagacacctgctcagtgtggctggaggttgaaatgccaccaggaaaatgccacttcataattgaaaggggaaagtaatgaaattgtctctggtttcagaaacttttcctcttaccttcctttctctttcctaacttaaaaataacagtttccatataacaagtagaaatttaagtaagtactctactaactaataatcatttcagtcagataaacctaaacattaaataaatatctccaatattaggatggaatacatatgtatggcatgtactagattgtcctatattttatgtttatttggatttgcttttatttgtaaaattattcttttctgaataaactgcatacaattcaaaatg

SEQ ID NO: 465870 - DNA, 757 bp, Homo sapiens
gtggggagtgaacattgagcacgcatagacataaacatgggaacaacagacactgtggaccacttcagaggggagggagggggaacacgggctgaaaaaccatctttcaggaatctccacactgtcttccacaatggtcgaactaatttacactctccaacagtgttaaagcacgtggaaattgagctgaagccaaacagatctggccttatttcccatgggcctgtgcaccaccaatttggatctgagatcagacataaccttgccataagcagcaaagggcttggtgaaccctcaaaaaggctgtcaaacacccagaggccttggggatcaggaaggagctatcatgtggtctttcataaaaaactggttcacccataccaagcctacacatttcagcccatgaggatggagaaaaagaagaaattgatgacagattctatcatcacaaaaggatgtgatttggaaactatggttctaaaaggagaggtaaaggaggtccaaagttatgagaacagaagtaaatacatggaggtagaatgtggtgcgtgaaggtgacagaggaatcaggtcttcaactctcagagaacagggatattctaatttgctgatttttttgacattatgataagccaggtttgaggaggtaaacctgctacctgtgtatgctagccatcactgagcacgaatgacctgattcattcaatgtgagtgtatctggtgacactcactcactgtcctgataaacactgttctc

SEQ ID NO: 465871 - DNA, 1489 bp, Homo sapiens
tctgcggtgagggtgacacagctgaataggcacaatgggccggaccagtgccgggcacgcggtgcatgcgaagtcagtagttataactgctccgctgtcagcattcccaaacgcagactgtcagctgtctccaagacattcctctatggatggagcatggatctcctgctccacaaaaagctgtcctgctctgctgtgggtaaatgggcccagaaatgaaattactggcatcccagacttgatcctgaaaatgattcatagtttgaaatccacttctcctatttatgttgacaaaaatttccacgctgagtacaacttggaaaagggcctgtggagaagaaataatagattctgtgctatttcttgtgtttcgacacgaagcctgtcctggaatcacctggaggacgtacacaaacacacagtgcctgggcttcaaccgggaccaagcaaacctgaagccaaagaatgtgtatctaatttgcatcataaagtgattgatgccatcagctgtgtttatgccatcagttagtctgtattgatccagggcgtattttgtgcagatggggaccctgggaagttagcagcaatggagaaaagcgtggaatgctctccaggtaatcccatagtggcagcagtaacaacaatggcaacagcagcctggagagcaccgaaatacttaaagctctgagggaagcgagtcttccctccactagagaagctgtggtcccaagagggtgggacaaaataccattcccttttctctctctctgttcatacactgcctggtgggacagactcaagtatagccatgagatgtatgcagcaaggtaggaaaactaaagacctagctttctaaccagaggacaaaaaaaatggggcttcagtgggccaaaaatgccagaataatctcagaaaggagactgctcaagagagcagttccatattaactccgaggcttacttctaagctgcacatggtgtgagaactgaactgtgcatgagactatgatccaggccaccaaatggccactgggcaacatacacacaacagattcccatagcactgcaaaggctttgaaaactgaactgatattagaaccacagtccacaggagaactcgagtctggagcctaattagactgattgcttgcaaaaacaaaacaaaacaaaattcaaaattcgctttaggatttaaacaagacatggatcctcataatgtaatattcaaaatgttcaggacacaatccaaaactacttgacatatgaaagacaagaaaaacttcaacttatagggaaaagaacaatcaacagatgccacctgcaagatgacacaaatgttgaaattattaaagatgcaaaggcgactattataaacatattccaagaagtaagggaaaattctcttgaaacaaaaaagtctcaataaagactatagaagatacaaagaaggacaaaagagaaactttttggaactgaaaattacaatgacc

SEQ ID NO: 465872 - DNA, 968 bp, Homo sapiens
tgtttgacctacttttccccaaccacagccgtcggaggttggagaagtcattagtggattgaatacaaatatttatagtataaattatctacagtataatcatctttcatgcagcctgtactaactttgacaaatttaggttgttactcaggctgaacctttggctcccagaggagatgcagcttcactctcaaggcatagactttgcatcctcctgagcaccaccagatatctctactgaagtccacagaacaagactattggactacatgttctgtatgttctctaacaaatatttagacctaaggattttgtttcaatgttttccttagagagataagattcatttatgtcatatggaatgatgaataaacctggctttggggatttgatggaccttgtatttttctctacaaggccttctggaaaacatcgcttaatttatctgtttcttaatttcccatctgtaaaaaaaagtggcaataatgcttatcttttcaaagttttatgagttagataaaataagacatgtataatatctgatcaagtaagtactcaatggatagtaatttcctcctctaattgtcttcaataggtctagattcaatttttttaaaacaatgataagacttcatttgagggctattggacaaggtttgaggtggcaatgatgttaggtgtttgcaaattccatcatagtggctagaattaaggcttatgaatgtcaggttataaatggatgcctgagtgagtccaatggctctgtggcccaaacctatactggattttttatatttattcaaagagatcaacaaaaatgctgccactcttgtgtctgatattgctctaactatacaatctcttccatttcttttagtaaagagagctagaagtatttcattttatattaaatgtaaattagtagtttacattcactgtctttccccaggtctaagttaattctaata

SEQ ID NO: 465873 - DNA, 1401 bp, Homo sapiens
aaggactcagatgaacaaccaaagccatcctgaatcccctggacccctggaggttgggattgggcacaaggcacaactgctggagaaagcctgtacattctcctatgagcttttgcttttggaaaaatgcatccagatagagttccaggctacttttgcttcacaccttccccgaccccagacagaagtaagtcaagggagccagccacttggaaaaggcagaaggaagaaagaagaaaagattaagggtactgtctcccactcagcagtgtgcaaatgcaaaaagccaaagataaaagaaagattaaaatataacgacagaaaattaaaaacaagagcaaataagacagaaaggctcaaccaacatcatctcttctgcgagtgacgctataaagcccccacagccagtagagtatagagatgttactctttactgctttagaaacaccaaccttggtgattgtaaagaggttggagaagtcattagtggattgaatacaaatatttatagtataaattatctacagtataatcatctttcatgcagcctgtactaactttgacaaatttaggttgttactcaggctgaacctttggctcccagaggagatgcagcttcactctcaaggcatagactttgcatcctcctgagcaccaccagatatctctactgaagtccacagaacaagactattggactacatgttctgtatgttctctaacaaatatttagacctaaggattttgtttcaatgttttccttagagagataagattcatttatgtcatatggaatgatgaataaacctggctttggggatttgatggaccttgtatttttctctacaaggccttctggaaaacatcgcttaatttatctgtttcttaatttcccatctgtaaaaaaaagtggcaataatgcttatcttttcaaagttttatgagttagataaaataagacatgtataatatctgatcaagtaagtactcaatggatagtaatttcctcctctaattgtcttcaataggtctagattcaatttttttaaaacaatgataagacttcatttgagggctattggacaaggtttgaggtggcaatgatgttaggtgtttgcaaattccatcatagtggctagaattaaggcttatgaatgtcaggttataaatggatgcctgagtgagtccaatggctctgtggcccaaacctatactggattttttatatttattcaaagagatcaacaaaaatgctgccactcttgtgtctgatattgctctaactatacaatctcttccatttcttttagtaaagagagctagaagtatttcattttatattaaatgtaaattagtagtttacattcactgtctttccccaggtctaagttaattctaata

SEQ ID NO: 465874 - DNA, 322 bp, Homo sapiens
agcggccgcctactactactaaattcgcggccgcgtcgacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttga

SEQ ID NO: 465875 - DNA, 1806 bp, Homo sapiens
tgtgcagggcaataggccagccatgacggcaatgattgtcattctgaagtgcatggcccaaatggccccatggatgtataatctcctgaaagcacaggcccatggattgtcatcctgcagcagggggaagcaaaatgaaccaggactggaaccctggtcttttgagaatcccagaccaccagaatttgaagaactcagggaaactgaattagagtttttgatatggactgaatcactgtggaattattataagaaactctttggcagtggaacaacacttgttgtcacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttgacttttgtccatggtattttaattggatgacatcaaattgaacatccaagacactgtgtttcctgatcctcacgatacccccatgagagctgccctaaaagcagagaggcagcgtgatggagaggttcagcacatgctctctgatcccaggaatcctgggtatggtgtttcgtatctgtgtgacctcaggctggagtgcaatggcacgatctcggctcactgcaacctctgcctccctggttcaagcaattctcctgcctcagcctcccgagtagctgtgactacaggcacacgccaccacgcccggataatatttttttgtatgttagtagagacggggtttcactgtgttgccaaagctggtcttgaactcctgagttcaggcaatccacctgactcagcctctgaaagtgctaggattacaggcgtgacccactgcgcccggcctttctttttttgttgttgttggttttttatcttaacatttcttttttctgttgatgcttttcaagaattactgccttagaagaaagcaggcaatttatgagg

SEQ ID NO: 465876 - DNA, 1296 bp, Homo sapiens
tgtgcagggcaataggccagccatgacggcaatgattgtcattctgaagtgcatggcccaaatggccccatggatgtataatctcctgaaagcacaggcccatggattgtcatcctgcagcagggggaagcaaaatgaaccaggactggaaccctggtcttttgagaatcccagaccaccagaatttgaagaactcagggaaactgaattagagtttttgatatggactgaatcactgtggaattattataagaaactctttggcagtggaacaacacttgttgtcacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttgaaaaaaagtcgacgggccgcgaatttagtagtagtagcg

SEQ ID NO: 465877 - DNA, 1258 bp, Homo sapiens
tgtgcagggcaataggccagccatgacggcaatgattgtcattctgaagtgcatggcccaaatggccccatggatgtataatctcctgaaagcacaggcccatggattgtcatcctgcagcagggggaagcaaaatgaaccaggactggaaccctggtcttttgagaatcccagaccaccagaatttgaagaactcagggaaactgaattagagtttttgatatggactgaatcactgtggaattattataagaaactctttggcagtggaacaacacttgttgtcacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttga

SEQ ID NO: 465878 - DNA, 1244 bp, Homo sapiens
tgtgcagggcaataggccagccatgacggcaatgattgtcattctgaagtgcatggcccaaatggccccatggatgtataatctcctgaaagcacaggcccatggattgtcatcctgcagcagggggaagcaaaatgaaccaggactggaaccctggtcttttgagaatcccagaccaccagaatttgaagaactcagggaaactgaattagagtttttgatatggactgaatcactgtggaattattataagaaactctttggcagtggaacaacacttgttgtcacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattattttgcttattacggaaaaacacaccacataatgtcgacc

SEQ ID NO: 465879 - DNA, 836 bp, Homo sapiens
gtgtcctgaattctttttctggccgtggacagagcgatgaggtcggggcggctgctgggcgcacggcgctggcctattccctgcttccaggcagtgaccctggggacgcatccagagcttgggaattgcgccaaggctcaagccccgcctccgccggagggtgcagaggctcaggggtgtgcagaggctcaggtggatgcaaaggctcacgtgggtgcaggggctcaggagggtgtagaggctcagatgggtgaagaaggtcggggggtgcagaggctcggggggtacaggggctcagttgggtgccaaggcacaggagggtgtagaggctcaggtggatgcagggactcagatgcgtgcagaggctcatctaggtgcagaggctcagagtgggtgcagaggctcaggtgggtgcagaggctcagttgggtgcagaggctcaggagggtgcagaggctcatttgggtgcaggggctcaggtggatgcagtagctcagattctttctctatattgttgttatatgtgaaccctggcactatttttccagcttttagaaggagtcctcattttccagaactgtgagcaggaaagacagtctcctggattcactttttcctaataaaactgatgtgtttttttttcttagtcaaaagtcacataagatggatatatgctatgcaaaaaataacaagcatatagactgacagagtaattgattccttatgccagtagaagaacaatacctggaggtcctgaaaggtgaagataacagaatcacagggatggtttcccccacactgtccttgtggtagtgaagaagtctcatgagagctga

SEQ ID NO: 465880 - DNA, 4520 bp, Homo sapiens
gacaaatccataccaactgggaaacggagaccatgctgtgtctgtcaaactgcctgactctgttgtggcactcgagcagccatcgacaatgcttaaacaagcagcatggctgtgttccaggacatggatggagctggaagccattgtgctcagcaaactaatgcaggaacagaaaaccaaacaccgcatgttctcacttacaagtgggagctgaacggctctagtgctctagcactcagttgtgttagagtggagaggaaggagagcgaaagggaaatgtctctctacttcgctggctgttgtcgtggtcctctcttggatggttgcttctctctggcatccttggagatgtttgatcgtctgaagccttcttctctcaactcatcaaagtcattctccatccagctttgttccattgctggacttcaatcctggggcagcaagaataaagtaaatttggccgtggaggaagaagagcaaataccaggaccgttcgttattccttcatggcaatgggagcaggatcccgccctcaggactgtagggaagcgggagagagctccagaagaagataggaacatgtgggaaagtttggaacttcctagagacttgttgaatggctttgaccaaaatgctgatagtgatatggacaatgaagtccaggatgagatggtctcagatggagataagaaatttattgggaactggagcaaagatgactcttgctatgctttagtggagagactggggacattttgcccctgccctagagatctgtggaactttgaacttgagagagatgatttagggtatctggtggaagaaatatctaagtggcaaggctttcaagaagaagcagagcaaaagagtttggaaaatttgcatcctaatgatgtgatagaaaagaaaagccccttttctggggagaaattcaagctggctgcaaaaattttcataagtaacaaggagctgaatgttaatcaccaagacaatagagaaaatgtcttcagggcatgtcagagaccttcatggcagcctctcccatcacaggcctggaggcctaggaggaaaaaatggttttcctggctgggcccagggtccccctgctctgtgcagcctcaggacatggttccctgtgtcccagctgcttcagctccagccatggttaaaaggggccaaggtacagcttgggccattgcttcagagggtgcaagtcccaaaccttggtggtttccacagagcgttgagccggtgggtactcagaaatcaacaatcgaggtttgggaacctccccctagatttcagaggatgtatggaaatgcctggatgtccaggcagaagtttgctgtaggggtggagctctcatggaaaacctctgctagggcagtgtggatgggaaatgtggggtcagaaccctcacacagagtccccactaaggtactgcctagtggagctgtgagaagagggccactgtcctccggactccagaatggtagatccactgacagcttacacagtgcacatggaaaagccacagacactcagtgccagcccgtgaaagcagccagaagggggactgtatcctgcaaagccacaggggtgaagattcccaaggcagtgggagcccacttcttgcatcagcatgacctgcctaggatgcaggtgcaaggctgcttggctggcccatgggcccatgggaagtggcccatggggttgttcttaggcctgatatgtgggagcatggctgctcagctggtcttggatatgtctgctaaggtggctcatggggctgtttctcagttctggaatgtgggctcttggctgcttgaaggagtgggtgggggtgaggagtgcacaccttgtgctccttacctgggtgtagtacagctgcatgaattcctggtagctctctaaactgagcttagggcttgcaaggtatgggattctccagttgtaaggactgtaggttgagttttatacttttgtgtttctcatgatagtagttattgtccttttgctgccagatgtagaactcccttaagcatctggaagccctgaaaaactatctttctattaagaattctttcctaagtaatgatgaagattgacttttagtatgtattggtccatattcactttttacctctgttgggaaaataatattcctacatttttccctaatgcatagatacataagatgaaaattactcctcttacgctttgtccatcctcatgacacttggcagaaaatgctaatgattctgcatgtctactcagggtattcagcacacttgtgtactctttttaaaatttatacatattgcttacttcaatcactcctcttgatagtctattcccttttcaaattactgtcatggaaaataaatgccttaacattaattttaaccttcttcattagcaaaatcagagtgcagtaaataattcccttttggaatttaaacagacttttgctattatactgttgacctttttatatgctttcatgctgtggtccatataccacccatattcccatctcttggatttatttatcagttggctttattacctgatgctacagagagaatcattaatatcaatatgaagtgaaattattttgtaatttaaaaaaataacgtgagtgtgataataattttcctgttactttttccatgttttgcagcatttttaccaaactgtttagctgtgtgttctgattactctttcttgaaatagtgagggatttatttacacatgttgttaccaatacacagggtaagtgaattgtccttggactctctgttcattgtgtcatggacaaatacccttcacaagtaaacattgaaatgataggtctatgtgtgtaactgtcaggcctgttgcattttctgaaagacattcattcagcacgacccttctggactgtgattttctttcaagttgctgtttgtcttctctgatgtgttctattttgaaatatcaaattaatcatcagaaaatgcttgtcaatgaatgaattgcatttgctcaatatacacatatttattttcaggtagctttgaacacatggtaaggaaatacattcatcttttcactgagaactgctcacctaattgcttggtacagtcatgttcaatgatatgtagttgattaaaaaatgacaaatactgtgaccagctgcccttttgatgtcaaataatgtggaagattgaacaccatgctgatccattagccatttccaggaaacattgcagcgttataagagaaattatagactatttgttgaagctcagcatgtccatctccctgctttgaagaaggcaagcttcattaaaaccaacatcttacttggcctaaaacatctttggagtaggagatttatggcctttctgggaaagtagttctaatttttataaaccttagaattaagaagttcttttgtaaatacaattataattctttcttctcgattttgagtcatttattcttattcaatatccataaaagtaaataattgaaatacatatttcctcaccaaaattttattaattacctacataatttatctatttaggaaatggaattagaaacctgtaccttataaaattgatggtgaacatgaaatgagggaagttaaatcaaaaatctgctattactactattacttctggatgcccaggaagctggagagtggataatgtaaagtttctgcagggaagttccatgtttccatgactgtgctagccagcagcaacagccaagagtcataggaagatggtctttgcctcaattttctcttccacatatcacctgagcatattaacaaggtagaacctgatttgcacataataccctagttgcaagggaatctgggaaatataaattttagatttccagcttctcaactagaaagaggagaaaatggaggttgagtaagccattccagaaaagataatattattattagttaaaaatgtaataattattgccatctgaatattctaacttagggcaccacaaaatgaaaacctgatacactttacaatggttactcatctttcaatctttttgctgctcttggtgtctgtaggacactcctaactgagtaggacctttgctttagacacagctgttcctttttatcagtgtggtaagcagtttatgtctaacagcagttttatggtccactgactgtactgaaaggcagcgctttaccaaccatgaactttgacatatttatatccggtttttaatctgaaaacatgcaaaaaagagtcttctaaatataatttattatcagaacaactctcatgtaggtgttgaacagcatataaaatttatatttaggccttagattttgtcctccttcaagagacatagtgacatcagtaggtgaactgaaggttgaaatcccaattgctttgaggggacatcaagccttatgaatttgtattagtactaaaaacagcaggggaatagtataattaacatgtataagattccatttttaaatacaaagc

SEQ ID NO: 465881 - DNA, 1398 bp, Homo sapiens
tgcccgtgctttcaccgtgcaatgtgcctgctcctgctttgccttctgtcatgattggaagcttcctgagacctccccagaagcatatgccaccatgcttcctgtacagactgcagaactgaaacattgcagcgttataagagaaattatagactatttgttgaagctcagcatgtccatctccctgctttgaagaaggcaagcttcattaaaaccaacatcttacttggcctaaaacatctttggagtaggagatttatggcctttctgggaaagtagttctaatttttataaaccttagaattaagaagttcttttgtaaatacaattataattctttcttctcgattttgagtcatttattcttattcaatatccataaaagtaaataattgaaatacatatttcctcaccaaaattttattaattacctacataatttatctatttaggaaatggaattagaaacctgtaccttataaaattgatggtgaacatgaaatgagggaagttaaatcaaaaatctgctattactactattacttctggatgcccaggaagctggagagtggataatgtaaagtttctgcagggaagttccatgtttccatgactgtgctagccagcagcaacagccaagagtcataggaagatggtctttgcctcaattttctcttccacatatcacctgagcatattaacaaggtagaacctgatttgcacataataccctagttgcaagggaatctgggaaatataaattttagatttccagcttctcaactagaaagaggagaaaatggaggttgagtaagccattccagaaaagataatattattattagttaaaaatgtaataattattgccatctgaatattctaacttagggcaccacaaaatgaaaacctgatacactttacaatggttactcatctttcaatctttttgctgctcttggtgtctgtaggacactcctaactgagtaggacctttgctttagacacagctgttcctttttatcagtgtggtaagcagtttatgtctaacagcagttttatggtccactgactgtactgaaaggcagcgctttaccaaccatgaactttgacatatttatatccggtttttaatctgaaaacatgcaaaaaagagtcttctaaatataatttattatcagaacaactctcatgtaggtgttgaacagcatataaaatttatatttaggccttagattttgtcctccttcaagagacatagtgacatcagtaggtgaactgaaggttgaaatcccaattgctttgaggggacatcaagccttatgaatttgtattagtactaaaaacagcaggggaatagtataattaacatgtataagattccatttttaaatacaaagc

SEQ ID NO: 465882 - DNA, 4156 bp, Homo sapiens
gacaaatccataccaactgggaaacggagaccatgctgtgtctgtcaaactgcctgactctgttgtggcactcgagcagccatcgacaatgcttaaacaagcagcatggctgtgttccaggacatggatggagctggaagccattgtgctcagcaaactaatgcaggaacagaaaaccaaacaccgcatgttctcacttacaagtgggagctgaacggctctagtgctctagcactcagttgtgttagagtggagaggaaggagagcgaaagggaaatgtctctctacttcgctggctgttgtcgtggtcctctcttggatggttgcttctctctggcatccttggagatgtttgatcgtctgaagccttcttctctcaactcatcaaagtcattctccatccagctttgttccattgctggacttcaatcctggggcagcaagaataaagtaaatttggccgtggaggaagaagagcaaataccaggaccgttcgttattccttcatggcaatgggagcaggatcccgccctcaggactgtagggaagcgggagagagctccagaagaagataggaacatgtgggaaagtttggaacttcctagagacttgttgaatggctttgaccaaaatgctgatagtgatatggacaatgaagtccaggatgagatggtctcagatggagataagaaatttattgggaactggagcaaagatgactcttgctatgctttagtggagagactggggacattttgcccctgccctagagatctgtggaactttgaacttgagagagatgatttagggtatctggtggaagaaatatctaagtggcaaggctttcaagaagaagcagagcaaaagagtttggaaaatttgcatcctaatgatgtgatagaaaagaaaagccccttttctggggagaaattcaagctggctgcaaaaattttcataagtaacaaggagctgaatgttaatcaccaagacaatagagaaaatgtcttcagggcatgtcagagaccttcatggcagcctctcccatcacaggcctggaggcctaggaggaaaaaatggttttcctggctgggcccagggtccccctgctctgtgcagcctcaggacatggttccctgtgtcccagctgcttcagctccagccatggttaaaaggggccaaggtacagcttgggccattgcttcagagggtgcaagtcccaaaccttggtggtttccacagagcgttgagccggtgggtactcagaaatcaacaatcgaggtttgggaacctccccctagatttcagaggatgtatggaaatgcctggatgtccaggcagaagtttgctgtaggggtggagctctcatggaaaacctctgctagggcagtgtggatgggaaatgtggggtcagaaccctcacacagagtccccactaaggtactgcctagtggagctgtgagaagagggccactgtcctccggactccagaatggtagatccactgacagcttacacagtgcacatggaaaagccacagacactcagtgccagcccgtgaaagcagccagaagggggactgtatcctgcaaagccacaggggtgaagattcccaaggcagtgggagcccacttcttgcatcagcatgacctgcctaggatgcaggtgcaaggctgcttggctggcccatgggcccatgggaagtggcccatggggttgttcttaggcctgatatgtgggagcatggctgctcagctggtcttggatatgtctgctaaggtggctcatggggctgtttctcagttctggaatgtgggctcttggctgcttgaaggagtgggtgggggtgaggagtgcacaccttgtgctccttacctgggtgtagtacagctgcatgaattcctggtagctctctaaactgagcttagggcttgcaaggtatgggattctccagttgtaaggactgtaggttgagttttatacttttgtgtttctcatgatagtagttattgtccttttgctgccagatgtagaactcccttaagcatctggaagccctgaaaaactatctttctattaagaattctttcctaagtaatgatgaagattgacttttagtatgtattggtccatattcactttttacctctgttgggaaaataatattcctacatttttccctaatgcatagatacataagatgaaaattactcctcttacgctttgtccatcctcatgacacttggcagaaaatgctaatgattctgcatgtctactcagggtattcagcacacttgtgtactctttttaaaatttatacatattgcttacttcaatcactcctcttgatagtctattcccttttcaaattactgtcatggaaaataaatgccttaacattaattttaaccttcttcattagcaaaatcagagtgcagtaaataattcccttttggaatttaaacagacttttgctattatactgttgacctttttatatgctttcatgctgtggtccatataccacccatattcccatctcttggatttatttatcagttggctttattacctgatgctacagagagaatcattaatatcaatatgaagtgaaattattttgtaatttaaaaaaataacgtgagtgtgataataattttcctgttactttttccatgttttgcagcatttttaccaaactgtttagctgtgtgttctgattactctttcttgaaatagtgagggatttatttacacatgttgttaccaatacacagggtaagtgaattgtccttggactctctgttcattgtgtcatggacaaatacccttcacaagtaaacattgaaatgataggtctatgtgtgtaactgtcaggcctgttgcattttctgaaagacattcattcagcacgacccttctggactgtgattttctttcaagttgctgtttgtcttctctgatgtgttctattttgaaatatcaaattaatcatcagaaaatgcttgtcaatgaatgaattgcatttgctcaatatacacatatttattttcaggtagctttgaacacatggtaaggaaatacattcatcttttcactgagaactgctcacctaattgcttggtacagtcatgttcaatgatatgtagttgattaaaaaatgacaaatactgtgaccagctgcccttttgatgtcaaataatgtggaagattgaacaccatgctgatccattagccatttccaggaaacattgcagcgttataagagaaattatagactatttgttgaagctcagcatgtccatctccctgctttgaagaaggatgttgggaactgactgtaaggaagacaggattggagaaccaggtttagaagagaaaaggcagtgccagaagtttttgattggagaaaactacagggcaatgttgcacaagaaccattgctggactgcatcattgcttacccaacatgactcagcctcggtattgccactgactcacggagctcctaatagaggagaattagtgtcacagatcgactggaaaaccaatccacatgaagccaggaagagaaatgaagctgctgttgctgaatccatagctggccttaatgatgctggctaggaaagacggcccattctgggggagataagtcaattttgcagtgtctgttattatcatagtgactattgtcttcctgttttatatttatttacctaaattgttttggaaagactcagaggtatagagacatgcctactttttgcaaaaatcatcacactgtcatggaggtagtccaggctatggggctcttatttgttggtgtcttgggcaagttgcttgacctctgatcattgtttgcttattcttatatggcccctgtatttcagactcactctgtgtcaggcatttgtttacctttgtagcaagctcaggaggaaaataccattgcccttgttttacaggtgatgaaactgtacgttttccaaggacacagtgctagtaagtaatgaatgtgaaattttaactgtttcaatctcttctcagagccagtgctaactactctcctaaacttcctctcatctgtaaaatatggatgataataacacctcttacagagttgttgtacatattaaataatagaactgtgaaatgtgta

SEQ ID NO: 465883 - DNA, 824 bp, Homo sapiens
ttgcgcttaccaggtgaggagacaccccagcatgctttggctcaccctccatgggctgcacccactctccaaccagtcccaatgagaagaatcagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcaggccaggggaaggttggcagtcaggacattttgaaggagtatttctacaatgcaaagaaaaatctgtgacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttatt

SEQ ID NO: 465884 - DNA, 899 bp, Homo sapiens
ttgcgcttaccaggtgaggagacaccccagcatgctttggctcaccctccatgggctgcacccactctccaaccagtcccaatgagaagaatcagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcagccttggggaagagtgttggtctttggggcaatgtggaggtgtcttcctttcctgtactgacaagctgaacagacgcaccttgttggttcgacccatcagcaagcaggaccctttcagtaattgctctggcttctttccttctacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttatt

SEQ ID NO: 465885 - DNA, 341 bp, Homo sapiens
tgtaaagtattctattgattgcattgtcagatttatgttttagttcagtgcagtgttgtgaactttagacttatttgaaatagttatgtatgttcaatttcttaactcagaaaaattgaagagaacagataaggtgaacttatgttttccaggccaggggaaggttggcagtcaggacattttgaaggagtatttctacaatgcaaagaaaaatctgtggtgagacccatttagttactatgatttttgaaaatgtactttaaactgtttatcttgttatttcataaaataggactaatggttacaagaatttgagttcagaataaattcttattagcctg

SEQ ID NO: 465886 - DNA, 966 bp, Homo sapiens
ttgcgcttaccaggtgaggagacaccccagcatgctttggctcaccctccatgggctgcacccactctccaaccagtcccaatgagaagaatcagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcaggccaggggaaggttggcagtcaggacattttgaaggagtatttctacaatgcaaagaaaaatctgtgccttggggaagagtgttggtctttggggcaatgtggaggtgtcttcctttcctgtactgacaagctgaacagacgcaccttgttggttcgacccatcagcaagcaggaccctttcagtaattgctctggcttctttccttctacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttatt

SEQ ID NO: 465887 - DNA, 1092 bp, Homo sapiens
gattttccaggtgctgtctgttatggcttcccttggctatgaaagggaattccctgactgcttgcactttccagaaaataattgtgtggctgcatatggtgaagagaacagtaagcgctttaatacgcggatgcatatgctgatctctgacagatgttggtctttgggaacaacagaaaggggagtgactcagaatgtggtactatcggggctttctgagacctcagttcggctcctcccctcgccctgcaggctggttctgactctccacaccagctctgctccatgctgtggctgcctcgcccctgtcccttgtcttggttctaggtctggatggtcccggactctaacccacattcagctcagactcaccctggtgccaatcgcccacactatcctggaagacagggattcacttttcaagaacatggatcaagtagccactcagtggaaagcactgctctcagtgcctgggacacagcggtgaacaaaacaaaatctctgtgttcatggagatcacatgctagaaaatatttgcaatacctgccacgtccaaggttcagctgaggccaatgtaaagccagtattataggacacttctcagactgagagcccaatgtcgttggaaaccactgggccacaggaaaggcaggctctctcagtcctgctcctgccatggaagaagcctgctcccaccatgccttctgccacgagtaaaagttccctgaggcctccccagaagcagatgctgtcgtgcttcctgtatagctgcagaactacttatagatggggtcacacaccattctacaaagaggggagtctctccgtgaaatgacttgaacttataaagcgcattctgctatgtggttgcctcaccaactcccttcctgcctggactattacagtaacctgtggattggtctccttgccttgagacgatgacatttctggcacctaaacccatcagcatcaagttgttcttttgaaaacataaatatgaccatgttacatgtttttaaacctttcaatggaatactttcacctacaggataatgtttagattttttaacatggcatgcatgacgcttcact

SEQ ID NO: 465888 - DNA, 859 bp, Homo sapiens
gagcccgtggacatcccgttgtcccccttgcccacacgcgtcctctttcctcccccctggccagtctcgctgtctccgccttccgctccctggcggaggcggaggccagagagcgctccaaggaagactaaaaacccaggccgggaagcgcggggtgagaaagcgaggtgggtggcgagagcgtgagcgcgccctctgctgaccccggggagcgtggactacgagttggcgcccaagtccagaatccgcgcgcaccgcggaaaatatttgcaatacctgccacgtccaaggttcagctgaggccaatgtaaagccagtattataggacacttctcagactgagagcccaatgtcgttggaaaccactgggccacaggaaaggcaggctctctcagtcctgctcctgccatggaagaagcctgctcccaccatgccttctgccacgagtaaaagttccctgaggcctccccagaagcagatgctgtcgtgcttcctgtatagctgcagaactacttcaaatcatcccaacaccagagaacactaaatgacagtggacaggaagacagtgtaccttttgctcctgatgatcaagctgaactactttatcatgtccattctttgctgccagatggagaggagtcattccatgaaggtcaccttcattcagaagcctcgtatcacttatgtcttgtaggagcctctgacaggttataaattggcactgggattttgtgagctacccacgtgattctaatgtgcaacagtttgagaatttctggtctagagaaaatacaggcctttgcagtatcttggaggggagcttgttgccacccaaaactcagacattgaaggaaaaagg

SEQ ID NO: 465889 - DNA, 1108 bp, Homo sapiens
agaggtcctggtcggggacacaattacggtggcagtgtaacgccgggaaactttattgcatgaagtccctctcactccctctacctccctcttttacctgggacatcaatcttctcctgactttacatgtggactcgagttggaactatatcattggctgtcctgggtctccagcttgctggctgcagactccaggactccttagcttccataaccaggatgcaaacttcggagccatctgcatcagagggattgatgaagatcaacaaagtttgggaacacaggaaaggagcggggaggtatcattcagcagcccttgggcagttgcgaggcaagtcgtcaatggggtatggagattttccaggtgggtgtggttgaaggaagggaagaaagagtttaggagcacattacaagaagaaggtgactgtaaggtccaggctgagcaggaaggtaaagcaagaaggaaacatgaggttgtgaagagaattttaaaaagttccttcttacccaaaagaaaaaaaagatagcaaccttatgttggttctcaaattaaaaaaaatatttttactcgttcataaaatagaaaaatctgagaatctgtagcttagagaactacagtgtgggatgtctataaagaccaggttattttatcagctcctaacaccccttaatagaagcttagccaagacttgcactatttcagtctttcccattccacattccatggactcttgaagagacattgatgaaacggtgcagccatgaaccaccctcactcaatcctagtggcagaatcccccttttactgcagaatgagcttcttgctacagtgatacttgaaccccttagatatatcctgtactaattatattaaaacacgaccaatgcttttgctttgttgtcccccaaattaaacaccttaatcatgagaacccagagaattggatttagtgtaactgattccaaactgtcagtaagaacataatttatatttttctccaattcaattaaaagaaaattgacaataaaaagctgatcaatacgtgtagctcaggaggtagagcctgctttgagatgcagaagtgttttttttttttttagatctata

SEQ ID NO: 465890 - DNA, 1109 bp, Homo sapiens
gggtcagtgccagacttctctacttcctgacaaactgtttgaggagaagcatgaaagaagaggacagctgagcggggaacataggagaagtgcttgctagatgctacaaatagcaagtgtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggcctttttggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagtatgactgaatacccttgaaggcaggcacctgctacctgttgtattttcagactaattctgtatggttcatacattggttaaaatgattagtacattgaaatgagcacttcctgatagcctatagtgcctttatttgctagtacaagcactgattaccctgcatgcatcagatacaatgcagggagctgtaatggaagaccacctacccaccagttgtagtttgggttgaaattgtgtcattagctatcgattgttacatttattgatgacaaacatgtgctagctctatgctgcatggatttccagttatcatgcttaatcaacagtagcaacttttaatgggaatttgtattcccattttactataaaaaacctcttcatgaaataaaaccccaaattttcaacttagatttcatgtctgcaaggccttcaacctaccaccctaagtgtgagttagttgctcttgtaagttgcctccgtatcaaactatcccgtttttgttctatattttcattgcctttatt

SEQ ID NO: 465891 - DNA, 1676 bp, Homo sapiens
tccttctacctcgccagagtcctttccaaaggactagaaaccaaccatctggtgtgttttccattagtcggcatgaatcctgccatatcgcggggcgtggtgtttgccgggaaacttgtcctgtggcacagctcatggagaggacattggctgcacatagctgcagacgaagagcaagcatcacttttctcttgtacattcagggatgtgatgtccttggaacttggtgactctctgggtgtaaagtcccagtcccatgtgggtcccagcatcggtggtctggttgctgatgaagatcagactccaagtctaaattttctggagatctacacctcccaaaggaggctggcttctgatcagaagagcaccgacttggttgtcagggaccctggacatgccctcctgcctgccctcactggggcctccgtagctgctggggaaaactgcttcctatcatcactcagtgactggacagcgcactgggctcaggagaatgttacctcaatttaaggtattggtgatattaagataggaaaataatctttactttttattaagaaaatgtggtaaatatggaacatatctaatagtatatggaagctttgaaatttactgatgaaataaagccctgtggagagcccgttcctcttaatctatggaaacccccccggactctgaagctgctgcggctccttcccggccctgcgttcctgcttccctgggagatgtggccactctccagcattaaaaaaagtgttccttcatttaaaaaatagtttccatatctgtacaatacatattttagcatttctgagatctattacaatgttattattgtgttctctggggcttgctttgttcttctttctacctttctaagattccaccatgttgcttgtttagttcaaccagtgctgatagggacacgtttgcacttgtctctcagtgaacattcgcaagagattttctaggcctccaggcagaagccgctgctgacggggagagtctgctggaggaagtcacatggcagatgccagaggaccagcctgggagaggctttctagcaaccaggacacctgccgcagtgccacgctttctccaggaaacaaggacagctgcacgggtgcccacacgagagtcggcgaccagcctcggcggtggggttcctgcaacgcgtgttcctgctggggttctcctttctgctgttccgagctacagtgcggatcatgctccccatacgtggagtccagggacagcacagcccggggactgcccagccagccaggaagtctggctttcagagaactgggaagaccatcttccactttatcccatctgggagactgtaaacatggattccactgtctcggacagtgagacgattcccagtcttttcctgttcctcctctagatgctgtcttggacgcagtgaagtctgccgatggctgtttcagagccgttaggatggtgaagtgagacaatgtgaatggagtgttttgtgaggctcagtgctgcataaatgctagccattatctaatagcaagaattccttgaaatgtttctttctctcaaatttatgaaaagattagaaaatagttctaaaaattaaaaatgcttctggtcggagcggcttacatgatggcagtgaaagtgtgcagcttcatgggtcccactgc

SEQ ID NO: 465892 - DNA, 1180 bp, Homo sapiens
cagtccaggtggaagggaatctagtatggccccttgcagcacgggcctctgcctttcacacaacctgcacacaacccagagggagccaggtacagccgagtttgtaggtgtgaacacaatgtcagcaagaagcccagccagcttcacctcttactggcactggcagcgggactttgtggcacctagcctgggcactaaggcagcccagagggagctcgtcccagacaatcaagaggaaaagaggggaaacgagaaagagacggagaccggctgtcgtggccaacaatcccgcgaagagggaacggcggtccacgcacgggattcagcctccgatcaagcccagcaatgcggggcttgccaagcccgcgctcacctggaacccgtggcccgccagcgccgcttccgcccgcgcctctctcttcacacttccctgcgagcagagggagccggctccggcctcgccagccccagagaggggccctcacagcgcagccgccggctgaagggctccttgagcgcggccagagcggacgccgaggcggagccgagagcagacactgacagcacagaagacaagcagcagcactgaggtgacagaagccagagggcacccctgcagtccaggacggcatgggacacggaccacataagcctcgatggcccccaaaaagacagatatgggataactctatggatgcttcaaaagcacttaaaggataaaccctcaactatagagacacttatgcttccagaatagattataacctaaaggatgctagagtcaggattcaccctggctccctttctctgaggattctggcactttgagttcccactgcgtttattaaatgacatagtatagtccatgagacacagcaatatgtaacagacaatgaatgctatatgatggatccattcattcactgtatggataaaatatctaaggttatgcagtatgcacgaggcactcctgggtgctagggacacactgatgagcaaaagcagcctctgcccctagacatctgagtctaatggaggaaccagtcacgggacccagtttttctctcagagtataatcaccatttgcaggatttggaagaaaactaaagatcatgaaagttgttaatgatgcctggactagttttgttttataatataatacttccacaccctcctctgc

SEQ ID NO: 465893 - DNA, 1496 bp, Homo sapiens
ttactaccgagtcacatgcagcaccaaagtatattaccggtggaacatttccgagtcacagggcaccgaaatatgttagcggcagtggttctgtccaggtctgaagcaaactcaattcttgcctccgcagaagaaacgattcagctgaggggcattaagatagagacgcttcccccttcactcagctctcattcttctccttgcagccaccatgtgaagaaggacatgtttgtttcccctggggcctctccatccttgctgaactattacacagaatgtatgaaaatgcccggatgtccatggaagaagtttactgcaggggcagagccctcatggagaacctctgctaggacagtgcagaaggaaaatgttgggtcagagcccacacacagactccccactggggcactgcctagtggagctgcgagaagagggctgtggtccttcagaccacagaatggtggatccaccaacagcttaaactatgcacctgggaaagccacagacactcaatggcagcctgtgaaagcagttgagagggggctgttactctgcaaagccacaggggcagagctgcccaaggctgtgggagcccaccctttgtatcaccatgacctggatgttagacatggagtcaaaggagattatttaggaactttaagatttaatgactgcctcactgtatttcagacttgcatggggccttttgttttggacaatttctcccatttggaacaggtgtatttatacaatgcttgtacctcccttgtatctataaatgagtcagttctcacaagatctgatgaatttataaggggcttcccctttgctgagctctcactcctctccttgctcccaacatatgaagaaggatgtgtttgcttccccttccaccatgatggtgcatttcctgaggcctccccatccttgctgaatttagatggtacgtctctccttcatgtgctgcctggggttgaggagaagtggcatagagatacaagcctcctgggtgatgagaaagacagagaagcatttttcatagagagttgccaggattgctcagcatccagatcaaccatgaaaggcaccaggagaatgaacatctgcatttttcttgtccatgattcttctacataatgctactgaagcgaagataatctttaattgtagaaacaagaagagaagcaaatatattactagtatccagaagctccttcacagttttcagataatgctaatgagctagttcctggtttgtatcacaaacttctcccaaattcttcccctaaacattccttcatggtggagctaattagactattgcagctccaccgttcattactgcttgtattttgtaaaaattagtgcatatgtcatgggcctagggatacatccattgcagggaaatgggagtagggcattcccagttttagctataattgaaaattattcttagggacgaaaatgccattgaataattctgccttttctcctcc

SEQ ID NO: 465894 - DNA, 1055 bp, Homo sapiens
caaacagtctcccacatcctccttcccagacttccccatctccacgcctctctgaccacttttgcagcagaaccactattttctaggttagcagttctcaactgtgggtgagtttgccccttggagacatttgttgatgtctggagacattttttttttttgtcatcacaactaggtgcatgctgttgacatccagtggccctgctggaattcattaacctagtttcaggctctgtatgttgggactgatgaagcaatcctgaagatggttcctctggcatctcagcttcacaaattatgcacactcatttgagatactgattcctgaggcctgcccaggctccccggtgccacggtgtgtcttcctgtggaggaaatgaggctgacacaacaggcagaaggctccaacacaaagggttgatgatttatttgcatttctgcaaaaataaaagtgaagtgcagttaataacagatctgtctgatgacattcccacaaaaagggacaagcactcggtggtctttttctctgccctaattcagctgtgctgtaaattcttgttctctgaggaaactccaaggagcatgaccgagattttctttccttttcccttctgtgatgtgcacctgagcattttggatgcctgtaccccagaactaactagccacagtgaacatgcccagcatcataccctacccagctcccccgccaggactgtccactccagctcctgcgtgcacccatggctctcctttctcttcagaacagccttccaggctccatggacactgaccttgacctcatatgcacagaaaaggctctgggagacagaagtaactataagtggcttcagaatggcctttttctgcagtagaaaggaacctgctgtgccccaagttctattcctggtgccatactcttctgctcctttaagaattaaggaagtaggaactgtctcatctctgtatagctacataatagaaagcaattatttttgcaacttactttcttcatcagggtattacatgaatgagcactcggtaccatttatttagga

SEQ ID NO: 465895 - DNA, 873 bp, Homo sapiens
cgccatcttggttttggtgggttttggacagcttctttacgcatgctgttttatcagcaaggtctttgtgacctgtatcttgtgccgacctcctatctcatcctgtgactaggaatgccttaacctcctggaatgcagctcacatgccagaaactatacaatccaccccctctgaaggagtttgttcatttaaaaaaaaaaaaagggaaatttgggtgcagacaggcacacagggagaacaccatgtcaacacgaaggcagaagttggagtgatgagtctacaagccaaggattgccagcaattcatcagaggccaggacagcagcctggggcagccccctacatggtaccaactccatcaacaccttgatctcagacttccaacctccagaactgccagccctccatgaatgaggaacttcctggggccactagtgcatgctgcagctcacacagtcaactccatccacacctccacaaacagctgccctttggccactactcaggcgtaaggacacacccagcagggtatgccctctggaggtcagaccagggaagaagcccttgcacagtcaggagccagctcagcacctgtgatgctgaattctatgtggcaacttgactggacgcaggtgctcggattaaacctgatttctgggtatgtctgtgagggtatttccagaggagattagaatttgaatccgtggattggcaaagttggtgtctgccccagtgtgggtggtcaccatctactctcctgagggcctgaagagaacaaaaggcaaaggaaggaggaattcgcccttaacttgcttgccgcctgcctgcttgagcagagacatttcatcacatcttctctggccctcgactgag

SEQ ID NO: 465896 - DNA, 1443 bp, Homo sapiens
cgccatcttggttttggtgggttttggacagcttctttacgcatgctgttttatcagcaaggtctttgtgacctgtatcttgtgccgacctcctatctcatcctgtgactaggaatgccttaacctcctggaatgcagctcacatgccagaaactatacaatccaccccctctgaaggagtttgttcatttaaaaaaaaaaaaagggaaatttgggtgcagacaggcacacagggagaacaccatgtcaacacgaaggcagaagttggagtgatgagtctacaagccaaggattgccagcaattcatcagaggccaggacagcagcctggggcagccccctacatggtaccaactccatcaacaccttgatctcagacttccaacctccagaactgatcacagtctggaagtctgctcacagtctcaaggttggcatatcccctagagcccccagactcctcatcccatggagaccaacatggccaggggagggccagagcagggccttctaaatcacagaccccagggcaggagcccctccggtctggatctaaggatggtattttcaacaattcctaaatttttatcctaggctctccaaatgggagtctaaaggtctcaaaacatggtccagaagaagtatgcaaaaatgtaaattcctaggccccaacccagacctatgaatcagatgatctgtatgggggttcaaggaatctatattattaaacaatcttcctaaatgacttatgctctcgttcatgtgccccctttctctctctctctctctcgctggttcactctctctctctctcctcctgccccccattagtgaagacaggaggaaaatgccatcacttctcctgcctaattccatgatactcctgaagtccaaacaccccgacatggaaaatttgagtggaaaatccctcttgatcaagtcagcaaatctcctgccaaacaaattcttcccagtctttgaaagatccaatccccctattctggacacctttggcaggaatgaagaggggactctgtatgctcctgactggagcccaacctaccaatccccagccttcacactccacaccactatcctccttgagaccaccaagatcaacctcagcatgctccctaaccttgtttatgtcaacacaagaagcccaggactcccagatggcctcacagttccggccaactgggtgaatccagggttaaaaatggccacctacttttcatggggcccactcgacagctcagttgtttggaggtatagtgcttgcagaaccaaggtcacagatgatcagagttggactggggggcctcagaaggccccatctggctctcagatttcttgtcaattcagcgggaattcctggagcatctcggggctgcaggaggactcagcactgttggaagagttcgttgctggtaactagcacagt

SEQ ID NO: 465897 - DNA, 1253 bp, Homo sapiens
cgccatcttggttttggtgggttttggacagcttctttacgcatgctgttttatcagcaaggtctttgtgacctgtatcttgtgccgacctcctatctcatcctgtgactaggaatgccttaacctcctggaatgcagctcacatgccagaaactatacaatccaccccctctgaaggagtttgttcatttaaaaaaaaaaaaaggatcacagtctggaagtctgctcacagtctcaaggttggcatatcccctagagcccccagactcctcatcccatggagaccaacatggccaggggagggccagagcagggccttctaaatcacagaccccagggcaggagcccctccggtctggatctaaggatggtattttcaacaattcctaaatttttatcctaggctctccaaatgggagtctaaaggtctcaaaacatggtccagaagaagtatgcaaaaatgtaaattcctaggccccaacccagacctatgaatcagatgatctgtatgggggttcaaggaatctatattattaaacaatcttcctaaatgacttatgctctcgttcatgtgccccctttctctctctctctctctcgctggttcactctctctctctctcctcctgccccccattagtgaagacaggaggaaaatgccatcacttctcctgcctaattccatgatactcctgaagtccaaacaccccgacatggaaaatttgagtggaaaatccctcttgatcaagtcagcaaatctcctgccaaacaaattcttcccagtctttgaaagatccaatccccctattctggacacctttggcaggaatgaagaggggactctgtatgctcctgactggagcccaacctaccaatccccagccttcacactccacaccactatcctccttgagaccaccaagatcaacctcagcatgctccctaaccttgtttatgtcaacacaagaagcccaggactcccagatggcctcacagttccggccaactgggtgaatccagggttaaaaatggccacctacttttcatggggcccactcgacagctcagttgtttggaggtatagtgcttgcagaaccaaggtcacagatgatcagagttggactggggggcctcagaaggccccatctggctctcagatttcttgtcaattcagcgggaattcctggagcatctcggggctgcaggaggactcagcactgttggaagagttcgttgctggtaactagcacagt

SEQ ID NO: 465898 - DNA, 2642 bp, Homo sapiens
ccaggggtgcaaactccagtggccccggggcaagcagactcttctgcaccatggagccagagccagtccagcccggcatgcttatcgatgtctgcaagtacctgggctccctgcagtaccgcgtctggaagaagatgcttgcatctgtggaatctgctgatccctctgccagtccctcgcaggcaggttcctgtaccctggtcttttccactctgcccaacacctccaaccctcctggacacaggtcatattggattggggaccctcctccagtcttcatcttaactaatatgtgtacaaccaccccattcccaaataaggtcacactcggaggtaccaggggttgggactgccgcatatcttctgggggatacagcccaacccctgccaccactccagccctgggccactccttgcatggacttggggccagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttctcatcatgtcccaggaagtggcatcataaaaggaaatatttttttttcctaggagcagtgttaaaatttgggtcacattcctgaccaaggacagcatcctgccttttggccatccccttcagttcacaaaagctgacattttaaacaaatcatgactcacacgtattaattggttataaatatgttgtgtacactggttagataaaacttaaggccacaaggagggcccagaacgaagatgacaatatctacctcaggcacttgtggggattcgatgaggaaaatgacggtaaaaatgccaagtattgtgttctaaacctaggataggattaatacacattggtgaattcttcagaaatgggagattctgaatatataaattgtgattcccaataatgacaaatcccaaagaaaagtgagagattgagaaatagaagttacctgttttgggagtcttccgatttcttcagatttttaacaagaacgtttgcataaaactcatgttcatgaaaaactttcagtagcatgagaaaatggttatgttgtaagaaccaaaaaaataggattcaaagcagtaagtacaggcatgcagcgtactcacaacaagacaagcaggagcctgtctttaatttgtgttgtttgattagataatctgtttacatggctgtgaattccaaaggtacaaaatgtactagaacagtctgtctcctttttctgcccaaacactcagcaacccccctggtaggcaatatatattactagtttttttcaaacttcccagagatattttatgcatagcacatatcctgttgatgggtatattctgttcaccccaatacattataatttagagcagacaactctagctctcatccctaagcaacccaaccaaagaggcaaaaaccccaaagatgttactaaaatccttttctctcaagggggaggtttgtacgatgttttcattcagtccattcagtggatagattttactttttgttcgtgtttaaatatttcaccttaaggttttaaaacaaagagaaaaagccaagcagaaaccttaaagctgagacctcaatatacatgtcgcccaggctgaagtgcaatggtgtgatctcagctcactgcaacccccgcctcccaggttcgagcaattctcctgtctcagcctcctgagtagctgggatgcatgtgccaccacacttggctactttttgtatttttagtagagatggggtttcgccaggctgatctcaaatccctgacctcaggtgatccgcctgccttggcttcccaaagtgctgggattacaggcatgagccactgtgcccggcctcaatgtgcatttttaaaatctcaattcattagaacccttacaaaggtttctagtggttaagaggctgggataccagattggacaacctggacctaaaaccctgactgaaccactgtctgaccttgggggagttacttaacctctctgtgccttagtttcatcgtgaggaaaatgaagatagtaagagttcctacctcacagggtggatatgaggttaaatgagcaaatgtgtgaaacacttagaagaggatctggcacagttgagagtttactgttgtctta

SEQ ID NO: 465899 - DNA, 1498 bp, Homo sapiens
agcggagttactcattttgactcgtttggacaagtgagttactacagcgctgatttggaaaaatgactagaaagctacctccaatttctcggcctcaaccccagcctcattttctttctgttccttcccgctctcgtcttccagccctccttccccccgttactcctcaaacttcctgccgtcagcctcctctccagagccgtccaagttgttcgattttctgccctacccgtttgcccaagctgactaatgtcgccccttcccagtaccctacctcaaggaacttcctgcccggcccttcctctgttactaccagggcgtccgtgtgccgccgccctgttcgtcaggcacccctttcccggtgtccccctatctttccccctcaccctcctcatagcccttctttctagtcccctgtactctagtccccactccctatccagccacccccaaccagacctgacggcttgcaaatctcaccctggagaaatggtttccctcctactggggcagttcccaggcggtccagaattgccaggacttgtggattcccagcagcgacctggcagacacggggaatccaagaccatggcaagcgaacattcggcctggcctgcgcctttcctctcctgcctgggcagccagactgcacaagcctctgcatttgaactggcttctccgtggaacttggtttgtaaccacggagcaaactgcaggaccaggggcagagaagttgatggcgagcctttttcctggcagtatccagaggcggttctagtaaagaggctggattccgagaggccagagcggtatcatacgaacgccgttgcctggagacggagtggggtgccattgcctagagactgcagaaggcccgcagccaagcgagtgagagccccggacccacggagcagccccaaggctatggcgggacacccgaaagagagggtggtcacagatgaggtccatcagaaccagatcttgcgggagctgtacctcaaagagttacgaacccagaaactccacacgcagtaccatgtgaatcccctgcgcaaggttcacaggattacgaggaagcctatgtcttggcatgataacctggaggaacccgcagacgccaggtttctgaatctcattcaccatgctgcccaggggccaacgaagaagtacccggaggcacagactgaaaaccaggaaattgggtgggactcagaagccttggtcgacccagaacgccgtgaccacaggatgaaccacttcagggtctacagtgacatcactctgtacaaagctaaaatgtggagcttgggagaagatgatcgccacaatgactaatgttagcattttaaaccatttgtttttaaaattaataataaattgcatatatttattgtgtacaatgtgatgttttgaaatacgtatacattgtggaatggttaaatcgagtatctcacatacttattttgtggtgagaggacttaaaatctattctcttagc

SEQ ID NO: 465900 - DNA, 747 bp, Homo sapiens
ccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgtcagttcctgttaaagccatgttgaatatatctgaaagctgtagaagtcctgaagaaagaatgaaggaatttattggaattgtttggaatgcagtgaagcatctcacactacagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcaca

SEQ ID NO: 465901 - DNA, 750 bp, Homo sapiens
ccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgttcgttccatttcaatggaacgaacaggctcctctagagggatatgaagcaccgccaggtcctttgagttttaagctgtggctcgtagtgttctggcgagcagttttgttgatttaactgttgaggtttagggctaagcatagtggggtatctaatcccagtttgggtcttagctattgtgtgttcagatatgttaaagccactttcgtagtctattttgtgtccactggagttttttactactcaggtgagttttagctttattggggagggtgatctaacactcttacgc

SEQ ID NO: 465902 - DNA, 1154 bp, Homo sapiens
cctggccgagaagctccaccgctgtagccaacgaggccaggctttatttcagtgaataaagatgaaacagctgctttattgtccagctcagccctcatgcattcaatagaggatcataatattttccagctttctctaactagttatttttctgtgctttctgaatatgctatggatatcttttgtcagacaaaacgtagagattttcagtattcttcaaaaaagttggactatccatattaacatgtacataatcagtttgtaaaagtatgtttctaaaaacataaggattttttttataaggatccattttataaggataactttataaggatacttttccattttttgaaaacataattttcaaagtgaattttaattttaacttgctctttccatattattttaatacttcttactaaaacttacattttctgggtacttacaggctctttggttttcactcagaattttaatttaaaatttaagtggataagcattgctctgtgtgtgcatgtgtgtctgtgtctgtgtgtgtgtgagagagagagaaaaaaaaaagcggggctgtggggacagatgagggagggagagattgattgatttacaataatgaagtctcagccccaacttgtgaaggactgtcctcagtattgccatgtttaacctttgctgcttaagaaatagtgaaaaactaaaaactaaaaaggttttcattttgtctctttccagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagatcttcctccatccctttattttgagcctatgtatgtctctgcacgtgagatgggtttcctgaatacagcacactgatgggtcttgactgtttatccaatttgccagccagtcaaactagaacccaggattaagaaactcactcaaaaccactcaactacatggaaactgaacaacctgctcctgaatgattactgggtagataatgaaatgaaggcagaaataaagatgttctttgaaattaacgagaacaaagacacaacataccagaatct

SEQ ID NO: 465903 - DNA, 562 bp, Homo sapiens
accataaggaagacaaaatactatataggacgaaagtagatcattcttgaaggtcttcatgttgaatagtagactgaggaggaggaagaggaggggttcgtcttgtctcagaagtggcagaggtggaagaaaatccacatcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagatcttcctccatccctttattttgagcctatgtatgtctctgcacgtgagatgggtttcctgaatacagcacactgatgggtcttgactgtttatccaatttgccagccagtcaaactagaacccaggattaagaaactcactcaaaaccactcaactacatggaaactgaacaacctgctcctgaatgattactgggtagataatgaaatgaaggcagaaataaagatgttctttgaaattaacgagaacaaagacacaacataccagaatct

SEQ ID NO: 465904 - DNA, 650 bp, Homo sapiens
gaaaaagctgtgttgatagcaaaatgcttctcgtaggactccaaaatcattatgatgttggtctagctaaggtcctcaacctctgggccgtggaccagttccattccatggcttgttatgaactgggccacacaaaaggaggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaaattaccactgatgctgaatatcttttataaattgtttgcatgcaccctcacaacttttactatttccatagcatattcttagaaatcggattattttatagaaaaaagcatacctattttccccatatataaaacattctcacaagaggcttcaacaatgacaaatttcataggtatacaacttaactctttaacatgtttccagtataacagatgaaaagtatgtctggtttgattgcactgtggtct

SEQ ID NO: 465905 - DNA, 718 bp, Homo sapiens
ccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagatcttcctccatccctttattttgagcctatgtatgtctctgcacgtgagatgggtttcctgaatacagcacactgatgggtcttgactgtttatccaatttgccagccagtcaaactagaacccaggattaagaaactcactcaaaaccactcaactacatggaaactgaacaacctgctcctgaatgattactgggtagataatgaaatgaaggcagaaataaagatgttctttgaaattaacgagaacaaagacacaacataccagaatct

SEQ ID NO: 465906 - DNA, 1404 bp, Homo sapiens
aagaaagggaggaggagccgcgctcgcccggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgcatgagccaactagatggagcaatctgacacaaaacccagggttttatgactgacctagtgcgccagctgcatctggaggaaccagacgcaaacaacgcagagttgagggccaggtgaagcgggatccagctccccacttcaccccaaccccttcgactcctcaaaacctctgcaagaagctatttccttcggctggcaacttacagccagcaggtcccttcctcgtgcagaataaagccattctgggaaattttaatccattgcctaaaaccactggtatgctgatagtttccacatctatgttcccacacccccacctgcagtccagctgcatctgtccacgtgtctacctggtgtctccaccaaaatcttcccgtggcttctcctctcacccggaatccagcttgaagaataaccactacctacatggccctgcgcgctgcggctccggacgccatcttggcctcagctcccaaagcaccttcccctctcaccgtgctccagctgcgcgctgtgctcctccttactcctacgggatacccaaccccctctccactggagctttgctctttccagtgcctggagcacacatatccaatatattgacagggaggactgcaggatccagctctaaagctgatcggcttttcatcccggggggacctttgaaaggctctgtgattgctggtggtcagggtcaattgtgcagatgtctttaagagtgtctcactggtgaccagaaagttactttgtcaaaatgacagatgggctgtgagcggct

SEQ ID NO: 465907 - DNA, 1303 bp, Homo sapiens
aagaaagggaggaggagccgcgctcgcccggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaaggtgattgatgtcttggccgtcttctcttctggctgctgcttcaggcatttttatttctctttctctcaccttccttttcactcagcttttggctggggtgcacatgggtggggaggagaagtagggtgtgtgtgtgtgtgtgtgtgtgtatgtgtgtgtttgtgtgtatgtgtgtatctggggctggaaggaagggggctctcctggaggagggatgaaagtatgtgagcatcttcatatttggtttgttttctaaggcaggttgttaaaatgtcgtagagaagagtcaaccaccatgcctctgcatatttgtacacacacacatgagcatattttgtcaacaagtttcaacactcagtttttccaggctccacactcaccctgcccacctctgccagagaagtctttaagcctgtattttatcattttcgtcctcattaaaattttcctttccttccaaattagatctaagtccctccgcctgtctttgaagcatctctaacatctccttactccagcctcattttccatcaccctccagccacatgctccttctggaatgtgctgttcctagtctcacc

SEQ ID NO: 465908 - DNA, 1708 bp, Homo sapiens
gatgaatgtgagaacacttgtattacccccaagacaccccgtgctctttagacctcaccatgcacccagaccccgtaccctcagccccagcaacccctaatcttcttcctgtctctgtagatttgtccacttctgtggacgtgtcctgtagacaggcacgacactacctggcctcctttgctgtccttgttgcaatcacttttctgcagtgccagtgcctcctgggaatcctgcttgcgtctttgggcagattccaaagggaggcggcccttgctacagctgcacctgcctcctccatcaccacctgcctcctccatcaccacctgcctgtcacctgggagtcaggcccgctgccctggaggtggggtcaaaccagtgccaaagtcacccaggagccagccagggcctgggagttctccctcatgacacgccggcagcaggtgaacattctaaggctgacacttctgggcattcgctgagatcttgggaaagaactagccccccggccctgctttcacttagagatgggaacaacgattgccctgagttcctgggagctacaggagaaatatgcgccctgagttcctgggagttacaggagaaatatgcacggtgtgcttggcctgtggcaccagagctttagggcactggtctttcatcgctggccatgaaacagcaaggctttgaaaggaaggtagatggagtgtgcaaaccttgtgggaatctttgcttcttggcaaaagaatgaataagtgaatttggtcatggagaaaattgcatgctaggggcatgtttgtaactaccgtctgtgtttgtagtaaagcactcgataagtatttgccaaaagaatgaccaataaatcaatacagctcttaaatttttcaagccaatttgactttatgcaacttttgaagctctttcacagataatgaaacaaaggcacaaagaaattaagtcatacaagggccttggagagcttattgagcaaatattttgtgttttatttatcagttctgactaggattttataatttactcctataacttccatatattttccttttctaatgtattttctagattgagtctcatgaatattgaattttcattttgaaaaatttggatctgtctacacatatgaaattcaacccattaggcattcttataatttaaacaaatgttcttacataagaagagtaatacatttaagatatacctttgtcacaatttctgaactctacctaatgaaaattctctttcatgtttggaatattttccacttcaagtgcattttatccacataatgaggttcataattcattctttaatatttttattttgtacattctatgtatattatgcatgcatatgcacaaatactttattggtctccagattttattcactggcatgtcattttaaataaaaattggaaagtaaatgaaaataaatctatttacttagctaaattaacattaatacaagatacaacaaatctgcaaagattttcttcatccacggaaacgaggccctgagcattttcaaatgttgaggcttttcaaactctgctagttactgtgttagacagttgattcatgttcaagtaccttataccctcaggacttgccctgatatcttaaatgcaggcattgcaatgcattgctttgttactctacattgtaattgtctttgagccctccagtaggac

SEQ ID NO: 465909 - DNA, 809 bp, Homo sapiens
ccaacattagaacaatgaccttcaaaggaaatcagtctataagttcagatgtggataggtttgtaaatttagtattgaatgtaaatactgtcttcataatgtttttacttcagcgaagtaagaagcagggtcaccagctgatattaaggaaaggtgagatgttgaaggttgaggagaaaggaatgtccctgtgtccccagctcattaagcagagaagaaagtccaagacaaacagtgtaaaggaaaatgtcaacaataaagtcatcactggtgggacctcaaggcagcagagtggaatcacaactagatcctgcaatgtaactaatcaaaatcttatgaatttttttttacaaagcagaaattccatacgttttgacccacgaaggggagagcttcagcacatgaaacagattcgtctggagtaataggaagtatgtccaaatgagggaggaggcatccaaaaggacaagacctgctaagcactctgagagcatcgtctacacctgctgcttccagatcatcatctcccagttgttcccagcagcccagcagtctgacttccatccctaccatcccaacagaactgccctcgccaacctcctccacatgcaccatggtccgaagataatgaacactgctcaggactcgcctaactgggacaaaattgattcctatctggacgtgcagccatgcatgtccacgtaattatggataacagtgcagtgtcaccttagcaacaagtgatcagtctttcatttagaagccacagtttggctagggtaaatgttaatgagaggcttctaatggag

SEQ ID NO: 465910 - DNA, 1735 bp, Homo sapiens
tgtaagacgtgcgtttcactttccaccgtgtgatgcctccctagccacgtggaactgaagatgagtgcacctgcactgtgccggagtcccagcctcaagctcaacacagaagctgcaaagagaggctggtcctaaaatatgacattgtgaaaggaaaatatcttgaggccccaaaatcactaagctaaagggaaaagccaagctgggaactgcttaaggcaaacctgcctcccattctattcaaagctacccctctgctcactgagataaatgcatatctgattacctcctttggagaggctcatcagaaactcaaaagaatacaaccatctgtctcttatctatccattacctgaaagccccctccccgcttagaattgtcccgtctttccacactgaaccagagttcatcttatgtatcttgattgatgtctcatgtctccctaaaatgcataaaaccaagctgtgctctgaccaccttgggtacatgtcgtcaggacctcctgaggctgtgtcacgggtgcatgtcctcaacctcagcaaaataaactttctaaattaactaagacctatctcaggtttttgggattcacaacataaatatggataaccaatggattagaggaaccacacgttcggacaatcttagaaagatcttctgcaaccatgtcttgttgctgtttgactccagggcactgacgtgagaggtggtgagaaaggagtgggcagagaagccccagaaagactgaggttgattttccagctgatattgcaggatggaggcgcagagagggaatgaatttatttatttatttaattgatttttttttttttttgagacggaggcagtccacgtatctgtcctcaaagatcaccggcagggtgttccaatcgccgtcgatgtccaggcactctgcaggcagcgggggcatgctagtgaggtactccgagttccggatatccagggacagctggctgtgcgtctgtatcctggggagcacatggcaggggagctctgcaagagtggttcagacggctgaggctgcagcaggaaggtcccgagcactttttgagtctggactctatgtgggcaatgaggaagcagtgaagaccaatgggccaagaagggccacagcctcatctatctttggtgcagcattcaggctgtgtctggcctcagggcctttgccctggctgttacctccacctgtaatgcactgtcctcctgggctgcttcccaccctcagacctcagtttacctgagtccgggcttatgctgtcggactgtaaccctgactccaggaatacagaacgaaagcataagaacacttctgttttagaggttcaaaaatctgcatttcactttatttcttatcatgtgttctttaagatgatggctcaacagtgcacagagaagccaaagcaaggaggttatgagtgtggcctctgggctccaacagatccatgcttgtgtcgcttgctggctgtgtggtctaagataagttacttaacctctctgagcccaggtttccctagtttcttcttctttaaagtggggagaataatagtacctacctcatagagttcatgtgaacattaaacgagccaaagcatgtaacgcactcagtttctgatcagagtagtttcaatagactaagcaccatgaataaatgcctatttattggcaccaggtaaaatgcctattgtggtcaaccctacggacatagcatctctt

SEQ ID NO: 465911 - DNA, 3880 bp, Homo sapiens
gaagaaaaaagaaaaggaaaagttgggtgaatatcgtaatttaccctctgctgagactctaattgataatgcacccattgtctggcatggcaaatctctaatcaggaaactgtcctgcctttctaggaagccgctctgtgacccacctctgaatcccacaaaactgcaccagagagccgggcgcaagatgaaccagcaccctgtcggctcaagatgcaccagaccctctgcctgaaccccgagagcctgaaaatgtctgcgtgcagtgactttgtggagcacatctggaaacccgggtcctgcaagaactgcttctgcctgcggagcgaccaccagctggtggccggccctccccagcccagagcgggcagcctgccccctccaccgcgcctgcctcccaggcctgagaactgccgcctggaagatgaaggtgtgaacagctcaccttactccaagcccacaattgccgtgaagcccaccatgatgagctccgaggcctctgatgtgtggacagaggccaacctgagtgccgaagtctcgcaggtcatctggagacgagcccctggcaagctccccctcccgaagcaggaggatgcccccgtcgtctacctgggcagcttccgaggtgtacagaagcctgctggtccctctacctcccctgatggcaattctcgctgtcccccagcttacaccatggtcggcctgcacaaccttgagccccgcggcgagaggaacattgccttccacccggtgagcttcccggaggagaaggctgtgcacaaagaaaaaccctcatttccttaccaagaccggccctccacccaggagagcttccgccagaaactggctgcctttgctgggaccacatctggctgtcaccagggccctgggcccctgcgggaatccctgccctcggaggatgacagtgatcaaaggtgctcgccctccggggacagcgagggtggagagtactgctccatcctggactgctgccctgggagccctgttgccaaggctgcctcccagactgcaggttcccggggcaggcatggtggcagggactgctcacccacgtgctgggagcaggggaagtgttccgggcccgcagagcaggagaagcggggcccgagcttccccaaggagtgctgtagccagggccccactgcccacccatcctgcctgggccccaagaaactgtccctcacctcggaggctgccatttcttccgacggcctctcttgtggcagcggcagcggcagcggcagcggcgccagtagccccttcgtcccccacctcgagagtgattactgctccctcatgaaggaacctgccccagagaagcagcaggaccctggctgcccaggggtgacccctagcagatgccttgggctgacgggggagccccagcccccggcccacccccgggaggctacacagcctgaacccatctatgctgagagcaccaagaggaagaaggcagctccggtgccttccaagtcacaggccaagatagaacatgcagctgctgcccagggccaaggccaggtatgcacaggtaatgcctgggcccagaaagcagcatctggctggggccgggacagcccagacccaactccccaggtgtcagccaccatcacagtcatggcggcccacccggaagaggaccatcggacgatctacctgagcagccctgactctgcagtgggggtgcagtggccacgagggcctgtgagccagaactccgaggtaggtgaagaggagacttcggctgggcaggggctgagctccagggaaagccatgctcacagtgccagcgagagcaagcccaaggagaggcccgccattccccccaagttgtccaagagtagccctgtagggtccccggtgtcaccgtctgctggagggcccccagtgtcaccgctggctgaccttagtgatgggagctctggcggcagcagcattgggccccagcctccatcccaaggtcctgctgaccccgctccttcctgccggaccaacggtgttgctatcagtgacccatccaggtgtccccagcctgccgcctcgtcagcctcggaacagaggcggcccaggttccaggcaggcacctggagtcgtcagtgccggatagaggaagaagaggaggtggagcaggaattgctgagtcacagctggggaagagagaccaaaaatggccccacggaccattcaaactccacgacctggcaccgtctccaccccacagatggctcctctgggcagaacagcaaagttgggaccgggatgagcaaatccgcctcttttgcctttgagttccccaaggacagaagtgggattgagacattctcacctcctcctccgcctccaaagtcgcgggtctgagattccatcttgacattcatttgatcgctaaatattgaagacttcttttaggtggagccgtgaccatacattggtaggaaaagtacagattgcttacgagatgattttggcacacttgttgactgtatggagaaaacaaaaaaaaaaacaacattgaaatcctgccatatagtgtcatatagtgtatgtaaaagtggactgcagatggaataatgatccaaatgagaaaaataagaccaaaaagcaaatttaaaaacattcacagcatttttaagaccctagaagaataagccataaaatgatggctttgacttcatcaaattaaggatttctgttgaactgaggatgccatcagcagttaatagatgggtgagaaattaaagcagtgtatcaaagactgacaaggcattaacatgtaaggtgctcttgtaattcaagcagaacaatatgtggaaaccagtagaaaaacaggcaaaaacatggataggcagttaacaggagggaaaagctaaatgcagggcaagaatttgaagagctacttaacttcattaataatcagagaagcataaaacagtaaaatagcacattatgtccatcagattgatgacaattacaaagtgggataattccaaatttcagcaaaaatacaggaaaatggctattaaacagctgttaaattaagtatgagactacatcttgtccccacaaccttcattcctgagtatatattcacacaggtcagtaaggggacataaacaaggaagtttgtcataacattatagtagcagggagttagagcaagtccaggtattcatctctagagaaataggtaagtaaaatgttatgattatgaaataaactatttaatagcagtcagaagcaatgaactagaaatatgtccagaaacatgggtgaacctcatactggtattgactgaaataactaagagaatgaaatctatagcacaatatacttaatataaattaaatataaacagtttcataaaataacactatgtctgtttttaaggaaagctgcattcttaaccttttatgtagtttttaaaaaatagacatacacataaaatatgtatatatgttacatataacataaaattcaccatcgtaaccattttaaagtataaagtttaatagtagtttccatttgttgtatattaaatcagtctccagggaagtcttttcattttacaaaactgaaactctccacctttaaacaacttcctgtttctcccttcccttagcctctgggaaccaccattactttctgtctctgaatttgactactctaggtacctcatataaatggaatcatccagtacttgtctttttgtcatttgcttgtttcacttagcataatgttctcaagtttcatccatcttgtagcatgtgtcagaatttccttccttttaaaagttgagtgatagtccattgcatgtatataccgttgtactattgtgaaatacatatttggtcttttt

SEQ ID NO: 465912 - DNA, 2338 bp, Homo sapiens
cctccagtgcatctgttatcccatttgtccaattcaattgaacagccagtcaactcagtgcaaggaaaatttgtcgaagcagttgtttggtttatgcttggtttaggaggtccctcgtctgagctggctcactcgcccaccaacagcgggaagaagctctttgctcccgttccgtttccttcaggctccactgaggacgtgtcccccagtggcccccagcagccccctccactcccccagaaaaagatagtgagccgggcagcctcttcaccggatggcttcttctggacccaaggctcccccaagcccggaacagcaagccccaagctgaacctaagccactcggaaaccaacctttcaaaggcagtggccactggcttccggcagcagggctggcgggcaacagaggcggctgcgggagccctggcctccagtgcaaaggggcccccttccgcctcatcctcccagctgagcgtgtccagtcaagcctccaccgggagcacccagcttcagctgcacggtctcctgagcaacatcagcagcaaggagggcacctatgccaagctggggggactctacacccagtccctggcccgccttgtagccaaatgtgaggacctcttcatgggcggccagaaaaaggagctccacttcaatgagaataactggtcgctcttcaagctgacttgtaacaagccctgctgtgactcgggggatgccatttattactgtgccacctgctctgaggaccccggcagcacctatgctgtgaaaatctgcaaagcccctgagcccaaaacagtctcctactgcagcccgtccgtgcccgtgcactttaacatccagcaggactgcggccacttcgtcgcctcggtgccgtccagcatgctcagctcccccgacgcgcccaaggaccctgtgcctgccctgcccacacacccccctgcccaggagcaggactgcgtggtggtcatcacccgagaggtgccacatcagaccgcctccgacttcgtgcgggactcggcggccagccaccaggcggagcccgaggcgtacgagtcggcgcgtgtgcttcctgcttctgcaactctgcaacgggctggagcacctgaaggagcacggtgatcatccatccgggacctgtgcctggagaacctgctgctggtgcactgcaccctccaggccggccccgggcccgcccccgccccggctcccgcccccgccgccgccgcgcctccctgctcctctgccgccccgcctgctggtggcactctcagccccgcagccggccccgcctccccggaagggccccgggagaagcagctgccccggctcatcatcagcaactttttgaaggccaagcagaagccgggcggcaccccaaacctgcagcagaagaagagccaggcccggctggcccccgagatcgtgtctgcttcccagtaccgcaagttcgatgagttccagacaggcatcctcatctacgagctgctgcaccaacccaacccgttcgaggtgcgcgcccagctgcgggagagagactaccggcaggaggacctgccgccgctgcccgcgctgtccctctactcacccggcctgcagcagctggcacatctgctactggaggccgaccccatcaagcgtatccgcatcggcgaggccaagcgcgtgctgcagtgcctgctgtgggggcctcggcgcgagctggtgcagcagccgggcacctcggaggaggcgctgtgcggcacgctgcacaactggatcgacatgaagcgggccctgatgatgatgaagtttgcggagaaggcggtggatcgcaggcggggcgtggagctggaggactggctttgctgccagtacctggcgtctgcggagcccggggccctcttacagtcgctgaagctcctgcagcttctgtgagccaagccccagcctgcaccgtcgctgccccttccctgcctaaccctttcctgtctcgccttggaagcacccatgtctccctgggaaatggtacagatgactgggatacctggatgtaaaatatataaatatatatatagaaaatacatataccatatataaatatgaaagactaaggatgctgttgcccgtccacactcgtctcctctctgcactaagtcctccctgttttcttctgtaattatacacatttccagttccatgcaacgtcctgaggacagttctgtgaactgaatgcagcctggacactggcctcaataccttgtttaggatttcttcacccttttgtcaaattgttatttaaagaaaaaaaaaaaagaagaaaattccattaaaattttttttggttgagtcatga

SEQ ID NO: 465913 - DNA, 1032 bp, Homo sapiens
  misc_feature (4)..(6): n is a, c, g, or t
  misc_feature (8)..(9): n is a, c, g, or t
  misc_feature (11)..(11): n is a, c, g, or t
  misc_feature (14)..(15): n is a, c, g, or t
  misc_feature (17)..(17): n is a, c, g, or t
gctnnngnncngtnnantgaccagtaactacttccatgacgcataaacacatgcatgcgagcttagccactgctccggccatctgcagtggcagacttcttagcccctgttccaacagcacagctctcaatgtccccatcatcaacccctatgccagcagcagctccaccagtctgacaagaaaaatgtctccagatgttaccaatgtttcctgggggcaaaatcacccacatgagaactactcactagaaagaacatgtacattaggaaaggaagtcccgtatactccagtgatgattgaagagaaagaaggaagctgggtgacgaaggatgcactacactattctcaaggaaataataactctctccaatacaagctatggaaaagtacagaaaaggcccagaaacacgcaagttgggctttcagttgctgtgaggctcaaatgagaaaagtgtttatgaaaaggctttgtaaatttaagtgctatataaaaatttagtacacaaggctcattaagcatgtatttatagactatttttgttataagtgctatctatttttggttaggttgtttccttaagttcctgcaaaaggaaaacagcacatgccaacgtcaacacatctttgaaaagttgccaccaacgcttcgcataagaggactactggaagggaagctgaattcagggtcctattagggtgatatttgcgaggcactgtctaacccgagagagtcccgaagcgtcctgcaacaggaagatgccctggacccagtggatggtcaggagatgcgaagtgactgccagggtggcctgggcactcccaacagaccacaaatgttgatttcagaatctttggcactttccaaaatgtggctgagcagtaatttggaagcctaaatcctgactttagaaattcataagaacaaccaatgttttataaactcaacagaaagtaaaataaacaaacccagggttttacgctccttcgtgttatttttatggcaatctttcaaactagttcaaaatgttcaa

SEQ ID NO: 465914 - DNA, 523 bp, Homo sapiens
tgactgaacagttctttgctcagctgatggacttttaaaaatgtatggggtaacttcttttccatacccagatacagtaaaaagacacactcattattttttctagaaggaaaacagcacatgccaacgtcaacacatctttgaaaagttgccaccaacgcttcgcataagaggactactggaagggaagctgaattcaggtggctcttgtgacactccttaacccctgttaaaaaattcactgtaaaatctatactgaattttcctttaaattttggttgctgaatcaaaacttctcaaaagatttgtaaatttcagcaagaagtcagaaattccaactctaaaatgaattttctgactcaatattgaaaataaattcttaagtttagatgcttaggggaaaaacagctggagaattcaggagcctcccatattttaatacaaagtgacgtcattaccatcaaggcttccaagaactccttaaattgtgtggttaagcaacatctcaaagcacggtgatgac

SEQ ID NO: 465915 - DNA, 485 bp, Homo sapiens
gcaggtattaaatgactaatccagatctccagcaccacatcaagaaggaaaacagcacatgccaacgtcaacacatctttgaaaagttgccaccaacgcttcgcataagaggactactggaagggaagctgaattcagggtcctattagggtgatatttgcgaggcactgtctaacccgagagagtcccgaagcgtcctgcaacaggaagatgccctggacccagtggatggtcaggagatgcgaagtgactgccagggtggcctgggcactcccaacagaccacaaatgttgatttcagaatctttggcactttccaaaatgtggctgagcagtaatttggaagcctaaatcctgactttagaaattcataagaacaaccaatgttttataaactcaacagaaagtaaaataaacaaacccagggttttacgctccttcgtgttatttttatggcaatctttcaaactagttcaaaatgttcaa

SEQ ID NO: 465916 - DNA, 999 bp, Homo sapiens
tcaatttccccttttatggcattaaactctcttgaaaaacatagctatgccactcgacagtttctagtcaagaatgagacggaatgtgggagagggatattaaaagccctaatcccctcttctgatgttcgaagaaaggcaagaccagattcttgggagatccagagattaggggcatctgcacagaaagctcataaggacagggaccatatcggtctcaaccccataagtgaccgaggttctcaacatgcttgttggatgagtgaaccagcagactcagacaatgttaaccacacacttgaatctcaaagagtctttggtgcatttaccaaatggcaagaagtccagagtggctgttgggcactgaatgtgagagtgtttagatttgaaactttaagaattaggtggggactatgtcctaaaagactgttctcaatgccaaagactttagacttcatacactgatctatactgcagatcttagaagaagaaaatcaattctacataaatggcaaaagcagtgttccccaagctggggctgacagacccctgagaaaaaagcattacgtgctagtggaggagctggaagttgtggatctccaacactgatttccaatatttggttctcctctgctcctgatcacatgcgaaaattacactttcccatgttgtttcagcaaaacatcatccatcactgtaaattaatgttgttaatattgaacttactgattttgtggttttgatggtttttactttgtgaattatttttattaaaacaagcatatataaaagcatatgaatcgaatcttaaattttagctttgtgcaaattttaatataattccaaataatttacaaataatttaagaaacaccacagccttttaaaggtttaaaattttttttcttaattctaaattcttaatttggaaatatattactcaaatttgaggatcactgaactgtgagaataggaaaagggaggaaaagtcttagtaatc

SEQ ID NO: 465917 - DNA, 1509 bp, Homo sapiens
gaatatttcaaacggattaatgaaagcgcaaaagcagatgtgtgtgtctgtgtgtgtgtgtgtggtgccagcctgtcagtgaggatgcctgatccattgctgtggcctctgtcccaagcttgtgctgtcaatgcaccagtgctcaccaccagctcggcccagaggccccaggagcatgggagtaggaaggcaacaactatcctcatgtcccaaggcaaagccaccctcagtgattccaagataaacacctcttctgagggagacccactgagtcattctaaagggcacagccctaaactggagggcaccctcaggaagcaggaccttatgcagaagtccacacaagccctgaatgcaggtttggggacaatttgtgcagaagatccttgcatcctggtccttggaacatgggagtgtggtatagactccagatatccatcagctgtgcaccttgagctcctcatcctaggaaaatgctatgcacaggcgattgtgtgctcctttgccatgatgtatcttcaaaatgaagatgaattttggggacctgaacatcaatcttggtgtgatgaaagagagaagtagcaattttcctgatttgatgaaaacatctcagattcgctacatgtttagagacataaggtacaaatggtaatgaactcactaatcagaatttggttaagatgcagggggagaagaaagcaacaagataaaaattcaaaagaattaagtacatccttggttaagtgattcaccagggtagagaaatggccttatcaataactatcaagaagatttaagctcagggaaatagagctaatttccactagaataagtgagtatattcagcatcaatgcagggaatataaaaagtcaaagaaatatttaatctagtccaagcagatggcaacagaatgaaatagattccctaaaatagcactgaaagaatgaatattacagcatcttttaatcacccaatggctcacagcacaatgctgggcacagtgaaggtgttcaataaattactgttgattgcctaataccatgtgaaatgtttaaaatattctgaatgttatttttaagaaattttagccagaataattagccatttctgatacttacatattcagaatgactctcttatctccctacagctggcatcaagacttttatattggaggagccaagatggccgaataggaacagctccggtctacagctcccagcgtgagcgacgcagaagagggtgatttctgcatttccatctgagttgtttttcagaaaccccaattcccaccaacttcagatctccattcctaccaacttcagctctgctggtatgtggacatcagagaagggggaactggaaactgaactctgaccatatcattctgtgttctaaatgtcttcctgaggggcctggaggaagttacactcacaagccagagctaacattcttttctgctgaccccaaattttaaaataaagcttctcttccttaaccaattgcaa

SEQ ID NO: 465918 - DNA, 1151 bp, Homo sapiens
ttgagggttaattaagtgttgcttggctccatgcatgggaaatgcccagcttcgtgcaggacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatgtttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagaaggacagttactatgtttatacccagcaagagcttaaagagaagctgtatcaagaaatcatatcatatttcgacaaaggcaaagcaggattgaatgaatcgttaactacacaatgaacttgatctttagccttccttttgtccctgaagattgggctgatatcgcatggctcacagccctaaccttct

SEQ ID NO: 465919 - DNA, 306 bp, Homo sapiens
ttgagggttaattaagtgttgcttggctccatgcatgggaaatgcccagcttcgtgcaggacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcaggtaggcatgtgactcacctacctgcttctagaattcttggccatggcaagagaactatatgaatttggaaaat

SEQ ID NO: 465920 - DNA, 269 bp, Homo sapiens
gttttcccccaaccactcctctgttctccgcaggacttcctcatggaaacttttatcatgttcaaggacctgattggaaagaatgtctatgccaaagattggatggtgatgaatatgactcaaaacaggtgagacagcccatggctggccctgaggcatttgtctgaatacctaaggctgctgtgtgaactttgggaaatgtctttaaatccctttgcctcaaacccatcatctgtaaagtgaggatcttcctgctccagaggtcctaa

SEQ ID NO: 465921 - DNA, 1784 bp, Homo sapiens
tctcaagatttcatgacttgcagtatggagatgagcaaggagctctcaacatctctttcttccctgcccgcctgctctgagcccctgaacctaaagttggcaatgactataaagagatttcatgcgaagtcattctttctagcaataaaagaacaaatataccaaagtaaaggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctgtgaccaaggccaggagggctgttgtgaagagtgcctcctacgagtgcccccagaagacatcaaagtatgcaaatttggcaacaagattttccaggatggagagatgtggtcctctatcaattgtaccatctgtgcttgtgtgaaaggcaggacggagtgtcgcaataagcagtgcattcccatcagtagctgcccacagggcaaaattctcaacagaaaaggatgctgtcctatttgcactgaaaagcccggcgtttgcacggtgtttggagatccccactacaacacttttgacggtcggacatttaactttcaggggacgtgtcagtacgttttgacaaaagactgctcctcccctgcctcgcccttccaggtgctggtgaagaacgacgcccgccggacacgctccttctcgtggaccaagtcggtggagctggtgctgggcgagagcagggtcagcctgcagcagcacctcaccgtgcgctggaacggctcgcgcatcgcgctcccctgccgcgcgccacacttccacatcgacctggatggctacctcttgaaagtgaccaccaaagcaggtttggaaatatcttgggatggagacagttttgtagaagtcatggctgcgccgcatctcaagggcaagctctgtggtctttgtggcaactacaatggacataaacgtgatgacttaattggtggagatggaaacttcaagtttgatgtggatgactttgctgaatcttggagggtggagtccaatgagttctgcaacagacctcagagaaagccagtgcctgaactgtgtcaagggacagtcaaggtaaagctccgggcccatcgagaatgccaaaagctcaaatcctgggagtttcagacctgccactcgactgtggactacgccactttctaccgcagccagtatcaaacctaccttcccgctgtggacttaggccacaggataggacaagccctgggcagcctggggcacaacgagaggccaggagatgagctatgcctttgtgggtcaaactggggaaagttttttattccttgtgcctatgaaataccagcaatgggctttttccctaactcgactcacatcttggaagaaattgttgcaactgacttaaatcctttctggaacaagttggagaataatatcttcacccaacaggttctcatgaggctggatgaggtttcccttgtaaatcccagatggaatgaccaaggtgtctctttctcctcgtcacatcaccagcaaggcctagtggctcttgtgcgaacaggcctgagtgctgtggtatcaggtcgccctttgaaaaatcaggatatccacctgggtgccagaactccttgcaagcaagaggacctggggtgggtgtcctcagaggtggccctgtgtgggctggtttccatcaggccacatacagattggttggagctttgatgcattat

SEQ ID NO: 465922 - DNA, 1645 bp, Homo sapiens
  misc_feature (12)..(12): n is a, c, g, or t
  misc_feature (25)..(25): n is a, c, g, or t
cttgcccacgantcgatgctgcccnaatgttgggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctgtgaccaaggccaggagggctgttgtgaagagtgcctcctacgagtgcccccagaagacatcaaagtatgcaaatttggcaacaagattttccaggatggagagatgtggtcctctatcaattgtaccatctgtgcttgtgtgaaaggcaggacggagtgtcgcaataagcagtgcattcccatcagtagctgcccacagggcaaaattctcaacagaaaaggatgctgtcctatttgcactgaaaagcccggcgtttgcacggtgtttggagatccccactacaacacttttgacggtcggacatttaactttcaggggacgtgtcagtacgttttgacaaaagactgctcctcccctgcctcgcccttccaggtgctggtgaagaacgacgcccgccggacacgctccttctcgtggaccaagtcggtggagctggtgctgggcgagagcagggtcagcctgcagcagcacctcaccgtgcgctggaacggctcgcgcatcgcgctcccctgccgcgcgccacacttccacatcgacctggatggctacctcttgaaagtgaccaccaaagcaggtttggaaatatcttgggatggagacagttttgtagaagtcatggctgcgccgcatctcaagggcaagctctgtggtctttgtggcaactacaatggacataaacgtgatgacttaattggtggagatggaaacttcaagtttgatgtggatgactttgctgaatcttggagggtggagtccaatgagttctgcaacagacctcagagaaagccagtgcctgaactgtgtcaagggacagtcaaggtaaagctccgggcccatcgagaatgccaaaagctcaaatcctgggagtttcagacctgccactcgactgtggactacgccactttctaccgcagccagtatcaaacctaccttcccgctgtggacttaggccacaggataggacaagccctgggcagcctggggcacaacgagaggccaggagatgagctatgcctttgtgggtcaaactggggaaagttttttattccttgtgcctatgaaataccagcaatgggctttttccctaactcgactcacatcttggaagaaattgttgcaactgacttaaatcctttctggaacaagttggagaataatatcttcacccaacaggttctcatgaggctggatgaggtttcccttgtaaatcccagatggaatgaccaaggtgtctctttctcctcgtcacatcaccagcaaggcctagtggctcttgtgcgaacaggcctgagtgctgtggtatcaggtcgccctttgaaaaatcaggatatccacctgggtgccagaactccttgcaagcaagaggacctggggtgggtgtcctcagaggtggccctgtgtgggctggtttccatcaggccacatacagattggttggagctttgatgcattat

SEQ ID NO: 465923 - DNA, 1531 bp, Homo sapiens
gcctctcctatatgaactgtagtaatgagtcaccgaagagtagatgagggaagcatctcgtgagaatgaaatgtttagagcatcaccattttacactcccaagaaattactacgtctggatgatgatcgtcaagggttaatatctcaagagaagaacactgacggacactgcttgcctcctgatggaaagacacatcaaaacttacggtcttgcccaaggctcaagcctgagtctcgtcaagcctctgtctccagctgtcaatgtataggaaataccaaagacgtactgaagagtaccaggaccaaattcctgaccaagagagccttcatggagaaaatgggccagcttttccaactgctaaactctaaggaaaaaaaaagaatgaaggaaaaacctatagaagaaaaacaactagaagacatggaagaaaaatggggaaaattaagctatgatgtttccatctgtacagttggatgataaagccattaagaaatgtacggaatgataactataaaatcaggagaataattatagtttggagggaggaaggtggttatgattggtacatggaacaaggaggaagctctggggtaactgacagagctctattggggattaaaaggataaggtgtatatatgtttgtgcagtttcctgatttgtaattattttacaataaagagattaacacagtttatctttcaaattagtgcatcattcaaatttgtatatagataatcagtaataacatgaattagtgatacatgcaacaaaatggatggttctcaaaatcatgttgagcaaaagaagccaacacaaagataaaagggtgcataatgtgtttccaatcatatggagagcaaaaacagtcaaagtccatttatagtggtagaaatcaaaatagtggttaactcttggtgagaaaggatacaggtttgactagaatgaagcagaagagaaattcctggaatgtgaaaatgttctattctgattggggtgttagctatatggatgcatacctttatcaaagatcataaaactatatatacatataatatatgtgcatgtgatatgtatatgtatgcatatgtataatatatgtatacacaaaactgtatacccatgtaatacaggtatacattacagaatacacacacacacactcacacacacacacacgaaaaacaacacgacagcatttatcaaaatgactgattccaggtttgggttaggaaatgtacaagatgagccaagagtatcttgtcatgaaatgaaagcaaggatgctatctaagactactagggtttttgtgaagtgaactgtgtccccctaaaattccatgttaaagacctaacccccaaggtaactgtctttggagataaggccttttaggagacaatttaggttaaatgagcttatgctgccaaattttataaatcttattattgattcttatctcctttagagctttctccagttgtgtgctaagaaggaatttcattttgattatgaaacctttgtgtttcacattt

SEQ ID NO: 465924 - DNA, 1875 bp, Homo sapiens
  misc_feature (10)..(10): n is a, c, g, or t
  misc_feature (12)..(12): n is a, c, g, or t
  misc_feature (14)..(15): n is a, c, g, or t
aattttcttngntnntccaaaatggtgctaattcagctctacagcccccaatctttacttcaaagtctctttgtttccatgaatctaaagtgtaaagaaagtgttcctggaccaaacggagagttgggctgctatttctcacagcccaataacaagatgcaaataaactcgggaggaagagagtttttatttctgcaaccagttatagggagaagtcctggaaattatcgccagaccaacttaaaattacaaagttttccagagcttatataccttccaagctatatgtttatgtatcctctgtctgcagcagagaaagttcagcctgcaatttccatcgggcttctcattctccaagcactccttcctgcattttccccgaccaagcttgcacgactcacagacagcaaactcacctgtgccaagaaagagctgctgagggagctttccaggaaatgtctagaaatggggaacatgtcaaagaccaccaaaaaaaaagggacagttccctcactgatcaagatgttacttggtctggagaaatgtataaatgtgggtgtttgcggctctttcctcatggacacggtgctgatctctcaagacccacccagtcatgaggactttcctctttctctttgccgtgctcttctttctgaccccagccaagaatgcattttttgatgagaaatgcaacaaacttaaagggacatgcaagaacaattgcgggaaaaatgaagaacttattgctctctgccagaagtctctgaaatgctgtcggaccatccagccatgtgggagcattatagattaatgcagaagatttaggtttccagagaagcatacataacctagcttctttttactcttgcctctgctgtaggcagacactttaataaaaataaatgactgtctttgctcagtttgtcaagtgtttcatttagaaaggagaacaacactgcctgaccttgatgctccctccatcccggtttatttttctatcattctggagtagataaattgtcccaaagccatctgaaatttttcttaaaagaggactagaagagactagaaatcaacaaatctctagcttgtgctcagtctacctgtgtgtccctgcactgtgactgtcacaagaactttttttttttttttaaatctctgtcaccaggctggagtacagcggcatgatcttggctcacttcaacctcctcctcccaggttcagtgactcttctgcctcagcctcccaagtagctgggactacagggcaatgagggcttccattctggctcttcaccatgataaccttgggggcttcctggatttaaaacccaggaaagcaggggttgagaagggagagcctttgaccatggtctctagcagtttttcactctcctaaatgtccacgttcagcctccagcaagttgtcgaagtcaccgtaagtgttcctgctagtttatggtttcagagcttccattccaggagtaaagtagttactttcagtctttttacttgtagcgaccgaaaccagaactctgaaatacttcataaggactcagcaaataaagcttttattatttttttctcctaagaagatataggatttcttttgaagtttggttattcagtccctgtatatgaattaccttttttttttgaagaattgctgaatatttattatcatcagaatttttcagttttcttcagaatcctggtcacatagatgaccttgaatattggctgatgtttttcccttgaagctcatcatcaaaaattactaaagcctgacatgtggcaggctaggagggtcccatggatcctgcacatttgtgcttgctgtgtgtctgctgtgaggagagtatccgacggcctctac

SEQ ID NO: 465925 - DNA, 276 bp, Homo sapiens
tcccaagtagctgggactacaggtgtgtaccaccacacctggctaatttttgtactttttaagtagagatggggtttcaccatattgggcaggctggtcttgaacttctgaccttgtgatctgcccaccttggcctcccagagtgctggggttacaagcatgagccaccgtgcccggctctcaagaaattcttagctacccccatccctcaagtgagacaggaaggtcagatggggctggaatagggaaacgtcttcccctccaggtgggatatgg

SEQ ID NO: 465926 - DNA, 1221 bp, Homo sapiens
acaaccctcttcaacctacccaacagccagtacgccaaagagattgcaggcactggcaccatgtgggtgatcaatcaatgctttctgacagttgggagtcatggtcataatagctgtagcagtgaaagaagtggcatcaataattcagacagcagaaaaggagtgagaaagaaaacttcaggtggagagaacattgctggaaggcagataatttgtataaaagagcatgatgccttccagaagtgtcaggtgattaaatacctctggaatgtggtgtcctacagagtggatcctgcatcctacagagtggatgaatataaggctggagaaggaagcaggagccagtatcttggacatgtgaccaacatctcctgcttctatgctcccatctcagactttctactgaaactttttcattcatactactgtccccaaggccttacagagctagtcgtctcaaacaaattatttatgattgttatgaagcaggaatcactctgattggttgtgagagaggaccaatcagaggtattttcatttttcaactgccacacagaaaatggaggggttgccgctgccacacagcaattaccatgcagaaaaaggagttgagaagggagtagcctctgatatgtagtcagcatgaatcagccttaggttccctgcctccatacccaattcttctgcctcattatgattccactatgaggcatccagagtagtcaaacttataaagacagaaagtagagctgtggctgccaggtgggtggaaggagagagaagtagttattgcttaatgagtaggaaatttcagtttgggaagacgaaaaatgttctgaagatggatggtggtgatggtcgtgcaacaatgtgaatgtacttgatgccacataaaaagtggctaacatgaccacatggaaggagagaaaacacctgaacagctccaactgtggcagccataccagcccagatgccagacagtgaatgaagacgggcatcccattcccagtagaaatgacgtgaagaaccgaaaaaaactcaccgacagccctagatatacacctccaggtgaccaacccagacaccaccaacagttagcgctactccagctgaatactccccaacaaaaatctatccttgctatgtgttgcctgaattcatgaccaacaacggtatgaacataataaaatgattgttattttatgccacttaattttagag

SEQ ID NO: 465927 - DNA, 783 bp, Homo sapiens
ataaggtggaaggctggatgtcctccccagactcagctcctggtgaagctcccagccatcagccatgagggtcttgtatctcctcttctcgttcctcttcatattcctgatgcctcttccaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggttccctcatcagagacgtgcgacatgtaaaccaaattaaactatggtgtccaaagatacggaatctttatcctatggatctgccaagggaggggatgcccagtcctctgttcttcacaaggactcccttcttctggctaaggtttcttatgcaattatgcctcctacagaggaagaagggacaaaaactgaaaaagttgagcctgttcctcagtttccatccaaatggactcactgctatgggaattgccctcctacagtagacaagatggaactagtcagcaggaaaggaagttatttggctcactatttttggctgtgtgagaagcatggtgcctgcatccgctccttgttaggactccataagccttcagtcatagtggaaagtcaagtgggagcaggaatatcacgtggtaagagtggagcgagagggtgcaaggaggtcccagactcttttaaacaactacatgttgtatgagctc

SEQ ID NO: 465928 - DNA, 1495 bp, Homo sapiens
ggccattaccttccgaggtgccagtgcgcgctggggcccaatggctctgctccgtatatttcttctccgagagtttggagacgtccctctcagagaagctggagggtccctgtctgagaccccagatgaggatctggaatatccacaaagctgcgtccaggggaacgcgtggaagctgcagcggagcctcctgctcaagagaaaaggccagtctgaaacctacaagaagaacatgtgtcgggaactgcgggctgtgggctgggggctactggaggaggtgggcaggtggggagaagcacccccttcagagctgggggcttggggagtgggggcgaggggaggcttggaaagaatggagtgtgtggggcgggccgtcctggtccccagggcgctgggctttcttccctggcagactccgcagcgcctgagatgtggacgccttggaggcggagggcccaagtcatctttatgagcagcaaaagaaacccaaaactttagctggtttctccacccacagttcctcttacagagcacttcagagagaattttaaagcggtataacaaaattaagtatatactgtgttttatttttaatgtacacattttaaaagataatattagatacattatagaaaggaacgtaatgaaagaaataattcccataatatatcaccttctgggctaaaaattctttggctaaaatccaatatttattttatattaatgaatgcctacataaatatgttctttactgagggagcttagaaggacactttgaagtgggaagatggttcatgttcttgaataagaagactcatttttctcaagatgtgagctctttatcaattttacataaaccaaataaagctatcaaaatttttaacgtttttgaattacacatgctttcactattgtgatgacattaagaaaatttttgttttggtatcaggatgatgagttaaggaggatttttctcctcctcaattgtttggaatactttcagtaggtatgatgccagctcttctttgtacaactgatagaattcagctgtgaattcatctattcctgggctttttttacttagtaggctatttattacttcctcaattttagagcttgtttttggtccattaaaggatttaatttctttctgttcagccttggaagggtgtatatgtccaggaatgtatccatttcttttagattttttagttcatgtgcaaagaggtgttcataatattctctgatcattgtttgcattttttggggagattagcattgcaactcctgctttttttttgctttccttgtgcttgataaatattcctccgtccttttattttgagcgtatgtgtgtctttgtatgtaagatggatctcctgaatacagcacactgatgggtcttgactctatccaatttgccagtctttgtcttttaatttgggcatttatcccatttacatttaaggttaatattgttatgtgtgaattttat

SEQ ID NO: 465929 - DNA, 3817 bp, Homo sapiens
gtgatggctgtgtgtccttgggtccctctttgtcctccacccacacccaacaggatgttatttttgccttcagtgaacatgcataacactttgcatctctttcctggcaaatatcaattccatcttgtgtttgaagatgcaagaataaatgtgatggcagttcatgaggaaagaactggagaatatgagctgaccgcaaagtcaacagtgatttcccactgtgattccgttgttgaaaacgctaataccatctcaggctgcacttacaagagtgcaagtccagaacgaagaggacattgcctcatggttctttcagatgcatcttctgtgggagatctgatcaatgtggtcactgtgtttttcagacctggacctcaccttctgctcattaacatcctaaatcacacattcaccagtgccataacagtttcaggaacaaccatatttggtgtaaaaatgggcagcaccacaattccgagaaatctccatgtttttctaggaattttcatgaatcttctaccccttggttaaagaaaactataaaggcaacagccccaaacccccttggtggatctctctcttgagtacacctgcatcccctttttatgagtgtgtgctattctctttgcaataaatctctgtactttcactaatatttcccaattcatctttgaattcattcttaaaatggtgtcaagatcctggacactggttggggttgaggttccaacagcatttggggacctcccccagactactagtgtcacttttatcctctgaaagatagataaaaaagcatttgtccctggcgtagaccatcctatttttcctatggaaataataaacaattcatcctagttagtatagataatatattgtttctacgccaactcgccatttgtctttctcttccagaactgaatacttcaatagagtgctggactaggaaaggacttttgaatttctggcccagattcacatccctctgttaaattaagtttagcctaaagctgcctccttacatattttaacgtcagcctaaaggtttctccacacattgtgaactattacctaactggacgtgtgaccagtcagcattgttgctgttttgtagttgttctaacaggtgtgtcgggatatctcattgtaattgtagtttgcattttcctaatagttaatgattacaaatatctttgcatgttcttatttcatctgtatctcctctttggtgaaatgtctgctcatgtttttgcccatttgataactggatttgggggttgttttaattgttgagttttgaagccagtatgtatagggcaatttctgtatacaaggtacagggttggatattgagaaaatgggcagaacctctgtcctctatgaactggtttatttttattcatttccatacatatactatttgtttacacaacacccttggaactgtgttttgtgcaaatattactgaaataccaaggatttggtctagattctgcagcttgctacacagaaagccagagaccgagagccaatgactgagactatgagtattgccaaggaagaaggctttaatcgggtgctgcagctgaaaagatgagagctcagcctcaaatccatctccctgaccaactaaagctaaggatttatatagcagggaagaagacaggaactaggaaggggcaaggaagcgatcctgatgaatgaagggtcaggcatttcattgtctggatgtggcgatctgctcacactggtcacacctgggacttccaacatgaatgcttttgtcacggatgctgcgctgctgctgtttctggttcttactctgcttacaccaaggagactgatgtccctgctataaccccacttccgatgcagacagcaattccaatgcattgcagctttcaggattttctcactgtgtttttgcctctccttttctttaagacatgagcatttgtctacggggatggcctgaagtgtagtctccattacccagagtcatctcactctctgaccttgactcatgatctgagaacaagtgctcccctgcttgtcttcctgaggggcatctgtccctcttgcaaacagatttcctttgggctctgtcatttagaaatgcccttatttatctgaattatagttccagttcagaacatttacaaaggaacagattgctcccaattttaaagcaggtaaattctaaaagttggcaagccagtcatttagaatttgagcctcatattccataggtatgaaattatacataatgaaaaagttcccagggcagcccacaaaaagcctacttatccaaaataaagctaacctgagttaattcagctctatggcctagccacattcagcaatgtgtttccattagaatgcatgtcttatatcaactgggaagccaagaaggcagttcagaactgaactgaaatctatcctgtgttggaattttatagccagatatcagttaaccaggccccagtgagtggagaaatcttggatttagattctcatgaaattctttatcaaatcctgggatcttccaaaagactgtgtaaaattataatttaattctgcagaagtagaacctcaattggatatcatccacaaaagcactgcaatgtctatctttttgggatcatgtcaaagatcctaaatccatgcttactttggcagaaagtattagtgtttagttcattagtaattggcacattggaatgatatagagaagattagcacggccctgcacaaagatgccgtgcaaatttgtgaagctttccatatttttattgcatttactccatcatatgtgggagctaaaagaagaaagagctaccctgaattgagatgtgctgaattttgaagactcaacatggaaaaaataatgcaaaacatcttatcagcatgttcttacattaattatgttggaataatattttggttaagggaaacatattattaaaagtaatttcttcagtttccgtttactttttttaatgtggctactcaaaaatttaaaactccatacgaggcatgaatcttctgatagccagttaggaaagaaattactcagaggcccggccgcccatcgtctgagatgtggggagcgcctctgccccgccgccccatctgggatgtgaggagcgcctctgcccggccgcgaccccgtctgggagtgtttctaacattcagctagatccaaagaccatgatcaaaactcagttttctcatggtgcccttttgtatttttgaaatctttaaattatttttcttttataatagagctacctttactctctggtcaaggagctgttagagtgtgtgtcacttgcaaaaaaaaaaaaaaagaaagaaaaaaatggtaattacagtgtcaatattttaaaaaatattttggcactaggcttattcctaaaagtcgtctactgttttgtgagtcctgtgtgtgcactgtccagttttggcattactgttatgttggctttataaacaacattagacatgttgattttccttagaaaagttttaaaagtactagaataatctctttcttaaaatttttaaatttaaaatttcatttgtgaaatgacctgtgtctggcatttggataaattattcacttcatgtatattcattccttaggttttctaatttatttgcatagttaaaaagtgttttctctgtctttctgttatttcccaccctcctttctaattgtatgcgtttgtattttgcccctcttttttttaggatattaatggtttatctgttttatttaaaagcaccaggacttggattcatttatttttctgcc

SEQ ID NO: 465930 - DNA, 2360 bp, Homo sapiens
gaattgtggggcaagcttggccactgatgcagattctgcagcttgctacacagaaagccagagaccgagagccaatgactgagactatgagtattgccaaggaagaaggctttaatcgggtgctgcagctgaaaagatgagagctcagcctcaaatccatctccctgaccaactaaagctaaggatttatatagcagggaagaagacaggaactaggaaggggcaaggaagcgatcctgatgaatgaagggtcaggcatttcattgtctggatgtggcgatctgctcacactggtcacacctgggacttccaacatgaatgcttttgtcacggatgctgcgctgctgctgtttctggttcttactctgcttacaccaaggagactgatgtccctgctataaccccacttccgatgcagacagcaattccaatgcattgcagctttcaggattttctcactgtgtttttgcctctccttttctttaagacatgagcatttgtctacggggatggcctgaagtgtagtctccattacccagagtcatctcactctctgaccttgactcatgatctgagaacaagtgctcccctgcttgtcttcctgaggggcatctgtccctcttgcaaacagatttcctttgggctctgtcatttagaaatgcccttatttatctgaattatagttccagttcagaacatttacaaaggaacagattgctcccaattttaaagcaggtaaattctaaaagttggcaagccagtcatttagaatttgagcctcatattccataggtatgaaattatacataatgaaaaagttcccagggcagcccacaaaaagcctacttatccaaaataaagctaacctgagttaattcagctctatggcctagccacattcagcaatgtgtttccattagaatgcatgtcttatatcaactgggaagccaagaaggcagttcagaactgaactgaaatctatcctgtgttggaattttatagccagatatcagttaaccaggccccagtgagtggagaaatcttggatttagattctcatgaaattctttatcaaatcctgggatcttccaaaagactgtgtaaaattataatttaattctgcagaagtagaacctcaattggatatcatccacaaaagcactgcaatgtctatctttttgggatcatgtcaaagatcctaaatccatgcttactttggcagaaagtattagtgtttagttcattagtaattggcacattggaatgatatagagaagattagcacggccctgcacaaagatgccgtgcaaatttgtgaagctttccatatttttattgcatttactccatcatatgtgggagctaaaagaagaaagagctaccctgaattgagatgtgctgaattttgaagactcaacatggaaaaaataatgcaaaacatcttatcagcatgttcttacattaattatgttggaataatattttggttaagggaaacatattattaaaagtaatttcttcagtttccgtttactttttttaatgtggctactcaaaaatttaaaactccatacgaggcatgaatcttctgatagccagttaggaaagaaattactcagaggcccggccgcccatcgtctgagatgtggggagcgcctctgccccgccgccccatctgggatgtgaggagcgcctctgcccggccgcgaccccgtctgggagtgtttctaacattcagctagatccaaagaccatgatcaaaactcagttttctcatggtgcccttttgtatttttgaaatctttaaattatttttcttttataatagagctacctttactctctggtcaaggagctgttagagtgtgtgtcacttgcaaaaaaaaaaaaaaagaaagaaaaaaatggtaattacagtgtcaatattttaaaaaatattttggcactaggcttattcctaaaagtcgtctactgttttgtgagtcctgtgtgtgcactgtccagttttggcattactgttatgttggctttataaacaacattagacatgttgattttccttagaaaagttttaaaagtactagaataatctctttcttaaaatttttaaatttaaaatttcatttgtgaaatgacctgtgtctggcatttggataaattattcacttcatgtatattcattccttaggttttctaatttatttgcatagttaaaaagtgttttctctgtctttctgttatttcccaccctcctttctaattgtatgcgtttgtattttgcccctcttttttttaggatattaatggtttatctgttttatttaaaagcaccaggacttggattcatttatttttctgcc

SEQ ID NO: 465931 - DNA, 472 bp, Homo sapiens
gtcattcttttttcaaaggacaactttatgaaaggagctgagaatgtcccgggggcctgaagggcttgaaagaaaatgcagtctgtgtttacacctcaaagatgtgcaagactgtgtgagtgggggtaatattttgggaagagaaagcgcaatgaagatatataggtgaaatatctaagtagcatcaacaaataactgttgttaatgttgtttaaaaaacaattccctggcttcttgtatttggaatggattgtctccgtggaagcagaaactacctctctcttaccttctttcaggttttcctgggatcagctgcactccttagcaaaagtatattggagaatcaactgagaaagtaactgagacatttcaatcatttctaggtgtaaagaaagaccagatcccaggaaaatattacggtcagttcaatgcctaagtataacaccagcatcactggctgggaccctcagaa

SEQ ID NO: 465932 - DNA, 1750 bp, Homo sapiens
gtcattcttttttcaaaggacaactttatgaaaggagctgagaatgtcccgggggcctgaagggcttgaaagaaaatgcagtctgtgtttacacctcaaagatgtgcaagactgtgtgagtgggggtaatattttgggaagagaaagcgcaatgaagatatataggtgaaatatctaagtagcatcaacaaataactgttgttaatgttgtttaaaaaacaattccctggcttcttgtatttggaatggattgtctccgtggaagcagaaactacctctctcttaccttctttcaggttttcctgggatcagctgcactccttagcaaaagtatattggagaatcaactgagaaagtaactgagacatttcaatcatttctaggtgtaaagaaagaccagatcccaggaaaatattacggtgacttcccaagtatgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaagtggaattctacagaaaactgcatgctgtggctgccagtgctggcatgtggacgctggtgattgtcattgtggtacccctggttgtctcccggtatggaatccatgaggaatacaatgaggagcactgttttaaatttcacaaagagcttgcttacacatatgtgaaaatcatcaactatatgatagtcatttttgtcatagccgttgctgtgattctgttggtcttccaggtcttcatcattatgttgatggtgcagaagctacgccactctttactatcccaccaggagttctgggctcagctgaaaaacctattttttataggggtcatccttgtttgtttccttccctaccagttctttaggatctattacttgaatgttgtgacgcattccaatgcctgtaacagcaaggttgcattttataacgaaatcttcttgagtgaaagggtgggtcccctggatgatggagaagttcacaaaggtgctttgctgatggaacttgctgaaaagccactcataggggtattagaaaaagctgtccaaggggagaaactgcatctcaggccatgctgggcatctgcccaaggaaccgaatgcctttggaagctgctctctgaagggcagggatggctgtccacgaggaggccacatgcattgcgtgcattaggcaggagcctgctacgagaaagcaggtaccagagccagggagaaaagcctattcttccccaagtgctgcttcagcgccttgtaatgatgaagattagtttagcatcccacccattgtgtgaagaaactaatcctcgctggaggctgactttgacagaaaatcactgcgagtgcctggaacgtgggttctgagtaggagtccatgagggctagttactaaggaagaaacagtggagagaggcaagtgtcaggatcaggagggcaaaggttgagatgggc

SEQ ID NO: 465933 - DNA, 2800 bp, Homo sapiens
atcgggccgcagctccgcctcccgcagccagggccgtagtaacccattcatggggcccgcgcgcggctgcagccgggctccgtggcgctcgcagccaccgcctcctctcggctccaggtcttccccttctttttacaactgatcctgttggggattttttttttttctaaattggaacggtggggaggagcagggaggggggacctggaggaaggggagagattaggcagccatcaatttcctccagtttctcccagaacaggtgatgcttctaaattgtgatcactttcaggaggcagcactgcagctggaaggatgcgagcgacctagggtggagtggctgaggcggcagatctgaacttgcggaggataagaacccaaatttttctaagactcaaacttgggcacttgatcccttttcttggattgctttggaggagacgatttgctggcaacgttgggaacagtcaggactgtgttgtaactcttacttttaaagcgacagtagaggatcagactttttaaatgtttggaattcaagatactttaggaagaggaccaactctgaaagagaaatcgctgggcgcggagatggattcggtcaggtcctgggtccggaatgtcggagtggtggacgctaatgtcgccgcgcagagcggggtcgccctgtcccgggcccactttgagaaacagcctccttccaacttgaggaaatccaacttctttcacttcgtcctggcgctctatgacaggcagggccagccggtggagatcgagcggacggccttcgtggactttgtggagaatgacaaagaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacaggtagggggaaaaagtgatttttcaatcatttttggttccttttcttcatgaacctcaactctgagtactgatccatggagctttgctgtcaagttggtttcatgttatttcaagtcactaagctcatccaacaaaggcctcctcatgctggcctttcttggaagaagccagaatcttcctttggaacacgtgtctctaaatctgtggtggagtcttttccaggtgcaccagcttcagcctaataagtagtatgtgtggtgcaggatataagcgatggcacctctcctttcgggcagggtatggtctcaatcagttttctagaagaagcaatgtgccccaagttaagtggcacccactttattattctcggtgattgctgcttggctggaagattatcaattcagattacggtttaggggattatggcaagctctctgctgtgttcagggagattcctttctaccatggaggattgcattctgtgttctatgttatattcagaatgggaaagattctttgggacaagacactaattcactgaaatgtgatttaggcatcctcagctgtctgttttttgtgattggaaacagaacttacaaaccaatgaagaaataccaaattaacttccagaaatcatgtaatttttaagaaaccccatattcccatccctaatttttttctctttcgttaaaaaacggaataattccctattgcttctttctttgggttttcacatttctagccaggtcctgaaatggattggagagaccacagtctccaaagttgttattccaatattccaacgaattctcagttgggagaatggaacctctggcattcttcccagaaagccagcttggtttcttcgtggaaagtatagcatagcctaggaactgaggaggctggaattctgatcttgtcctagcttctgaccttggacaaagcactcagcatctttgttcttcaataatataatgatgggttaggaggtgcagtcacttctgtaggcttcaagaggctactgaaatatcaatggcagctttgcagtgttctctgagatgcttgaagaggatgatgggcaaatataaaatgtttgttggatgtgtatagtgtctttgccattttagaaggttccagtgagctgcgttttagggagctattggggttgctctggtcttttttgaaagtacagagaagcttaaatatatagagttgcaaggactctttggagtcagtcattttcctcatctagctgaaaaatctgaacgctgagcggtggcatgacttgcccgtggttgtgcagctggttgggcagagctggcattagaacacagctgtccttacttccaggctgggtgccgtaactcacgcctgtaatcccagcacttaggaagaccgaggtgggcagatcacttgaggtcgggggtttgcgaccagcctggtcaacatagtggaccccagactttactaaaaatacaaaaattagtcaggcatggtggcacatgcctgtaatcccagctacttgggaggctgaggcaggaaaatcgcttgaacccaggaggcacagattgcagtgagccaagatcacgccactgcactccagcctgggtgacagagacagtgagactctgtctcaaaaaaaaaaaaaaaaaaaaaaagaaaaagaaaaaaaggaatacagcagaactgtccttacttccagactgtgcttctctccatggcca

SEQ ID NO: 465934 - DNA, 2858 bp, Homo sapiens
atcgggccgcagctccgcctcccgcagccagggccgtagtaacccattcatggggcccgcgcgcggctgcagccgggctccgtggcgctcgcagccaccgcctcctctcggctccaggtcttccccttctttttacaactgatcctgttggggattttttttttttctaaattggaacggtggggaggagcagggaggggggacctggaggaaggggagagattaggcagccatcaatttcctccagtttctcccagaacaggtgatgcttctaaattgtgatcactttcaggaggcagcactgcagctggaaggatgcgagcgacctagggtggagtggctgaggcggcagatctgaacttgcggaggataagaacccaaactttgactacatcagtccgcacctcgccagtgaagcaaaggacgggttatcttttttttttttctaagactcaaacttgggcacttgatcccttttcttggattgctttggaggagacgatttgctggcaacgttgggaacagtcaggactgtgttgtaactcttacttttaaagcgacagtagaggatcagactttttaaatgtttggaattcaagatactttaggaagaggaccaactctgaaagagaaatcgctgggcgcggagatggattcggtcaggtcctgggtccggaatgtcggagtggtggacgctaatgtcgccgcgcagagcggggtcgccctgtcccgggcccactttgagaaacagcctccttccaacttgaggaaatccaacttctttcacttcgtcctggcgctctatgacaggcagggccagccggtggagatcgagcggacggccttcgtggactttgtggagaatgacaaagaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacaggtagggggaaaaagtgatttttcaatcatttttggttccttttcttcatgaacctcaactctgagtactgatccatggagctttgctgtcaagttggtttcatgttatttcaagtcactaagctcatccaacaaaggcctcctcatgctggcctttcttggaagaagccagaatcttcctttggaacacgtgtctctaaatctgtggtggagtcttttccaggtgcaccagcttcagcctaataagtagtatgtgtggtgcaggatataagcgatggcacctctcctttcgggcagggtatggtctcaatcagttttctagaagaagcaatgtgccccaagttaagtggcacccactttattattctcggtgattgctgcttggctggaagattatcaattcagattacggtttaggggattatggcaagctctctgctgtgttcagggagattcctttctaccatggaggattgcattctgtgttctatgttatattcagaatgggaaagattctttgggacaagacactaattcactgaaatgtgatttaggcatcctcagctgtctgttttttgtgattggaaacagaacttacaaaccaatgaagaaataccaaattaacttccagaaatcatgtaatttttaagaaaccccatattcccatccctaatttttttctctttcgttaaaaaacggaataattccctattgcttctttctttgggttttcacatttctagccaggtcctgaaatggattggagagaccacagtctccaaagttgttattccaatattccaacgaattctcagttgggagaatggaacctctggcattcttcccagaaagccagcttggtttcttcgtggaaagtatagcatagcctaggaactgaggaggctggaattctgatcttgtcctagcttctgaccttggacaaagcactcagcatctttgttcttcaataatataatgatgggttaggaggtgcagtcacttctgtaggcttcaagaggctactgaaatatcaatggcagctttgcagtgttctctgagatgcttgaagaggatgatgggcaaatataaaatgtttgttggatgtgtatagtgtctttgccattttagaaggttccagtgagctgcgttttagggagctattggggttgctctggtcttttttgaaagtacagagaagcttaaatatatagagttgcaaggactctttggagtcagtcattttcctcatctagctgaaaaatctgaacgctgagcggtggcatgacttgcccgtggttgtgcagctggttgggcagagctggcattagaacacagctgtccttacttccaggctgggtgccgtaactcacgcctgtaatcccagcacttaggaagaccgaggtgggcagatcacttgaggtcgggggtttgcgaccagcctggtcaacatagtggaccccagactttactaaaaatacaaaaattagtcaggcatggtggcacatgcctgtaatcccagctacttgggaggctgaggcaggaaaatcgcttgaacccaggaggcacagattgcagtgagccaagatcacgccactgcactccagcctgggtgacagagacagtgagactctgtctcaaaaaaaaaaaaaaaaaaaaaaagaaaaagaaaaaaaggaatacagcagaactgtccttacttccagactgtgcttctctccatggcca

SEQ ID NO: 465935 - DNA, 1617 bp, Homo sapiens
acaaaaggactcctgtgggaacggacagccagatgcagttgctaagacaaattaaatatttttcattcttcttctcatcatggcggaccctagagataaggcgcttagggactaccgcaagaaggtgcttgagcacaaggagatcgatggccgtcttaaggagttaagggaacaattaaaagaacttaccaagcagtatgaaaagtctgaaaatgatctgaaggccctacgaagtgttgggcagattgtgggtgaagtgtttaaacagttaactgaagaaaaattcattgttaaagctaccaatggaccaagatatgttgtgggttgtcgtcaacagcttgacaaaagtaagctgaagccaggaacaagagttgctttggatatgactacactaactatcatgagatatttgccaagagaggtggatccactgatttataacatgtctcatgaggaccctgagaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccattgctagccagctggactgcaatttcttaaaggttgtatctagttctattgtagacaagtacattggtgaaagtgctcatttgatcagagaaatgtttaattatgctagagatcatcaaccatgcatcatttttatggatgaaatagatgctattggtggtcgtcggttttctgagggtacttcagctgacagagagattcagagaacgttaacggagttactgaatcaaatggatggatttgatactctgcatagagttaaaatgatcatggctacaaacagaccagatacactggatcctgctttgctgtgtccaggaagattagatagaaaaatacatattgatttgccaaatgaacaaacaagattagacatactgaaaatccatgcaggtcccattacaaagcatggtgaaatagattatgaagcaattgtgaagctttcagatggctttaatggagcagacctgagaaatgtttgtactgaagcaggtatgttcgcaattcgtgctgatcatgattttgtagtacaggaagacttcatgaaagcagtcagaaaagtggctgattctaagaagctggaggctaaattggactacaaacctgtgtaatttactgtaagatttttgatggctgcatgacagatgttgacttagtgtaaaaataaagttaaagaaaataatgtatgtattggcaatgatgtcattaaaagtatatgaataaaataacatcataaaaattagtagttcaacttttaagatacagaagaaatttgtatgtttgttaaagttgcatttattgcagcaagttacaaagggagagtgttgaagcttttcatatttgctgtgtgagcattttgtaaaatattgaaagtggtttgagatagtggtataagaaagcatttcttatgacttattttgtatcatttgttttcctcatctaaaaagttgaataaaatctgtttgattaaaaaaaaatt

SEQ ID NO: 465936 - DNA, 1233 bp, Homo sapiens
gttatttgaagactctctcggaagagatagcgtttttctgcaacctacggtcccagcagaaaaaccttgtgatccttgttgcgggcgacatggaggaagactcactctacttgggaggtgagtggcagttcaaccacttttcaaaactcacatcttctcagccagatgcagcttttcctgaaatccagcggacttctctccctgagaagtcaccactctcatcggagacccgtgtcgacctctgtgacgatttggctcctgtgacaagacagcttgctcccagggagaagcttcctccgagtagcaggagacctgctgcggtgggagctggtctccagaatatgggaaatacctgccacttgaatgcttccctgcagtgcctgacatacacaccgccccttgccaactacatgctgtcctgggagctctctcaaatgtacaccttcgacccttacctggatatcgccctggatatccaggcagctcagagtgtcaagcaagctttggaacagttggtgaagcccgaagaactcaatggagagaatgcctatcattgtggtctttgtctccagaaggcgcctgccgccaagacgttaactttacccacttctgccaaggtcctcatccttgtcttgaagagattctccgatgtcacaggcaacaaacttgccaagaatctgcaatatcctgagtgcgttgacatgcagccatacatgtctcagcagaacacaggacctcttttctatgtcctctatgctgttctcgtcatcaccgggtggagttgtcacaacggacattacttctcttgtgtcaaactcaagaaggccagtggtataaaatggatgatgccgaggtcactgcctctggtatcacttctccttagagtcaacaggcctatgtcctcttttacatccagaagaatgaatttggaagacccagttacagggtgtccgcaggcagagaaccaagagctctttgtgctgaagacaattgaattgtggtgaaataatatgtcatgaataaatcttgcagcagatttatttgtctcactttgtaatcagtgaatgagctttaacgaatatcaatgcctagtgcctaccccccagagataagaacttccagtttctcatgtgtaatcatggcatctggattgctcatgattctgaagataattctcctgtcccccaaagtttcagaatcacttcaggtggtagaaacagataacacatcagt

SEQ ID NO: 465937 - DNA, 2639 bp, Homo sapiens
ggatctggtaacatggcaaaagatgccggtctaattgaagccaacggagaactcaaggtcttcatagaccagaaccttagttccggaaaaggcgtggtgtccctcgtggccgttcacccctccaccgtcaacccgctcgggaaacagctcttgccaaaaacctttggacagtccaatgtcagcattgcccagcaagtggtgattggtatgcctcagagacctgcagcgtcaaacaccctggtggtaggaagctcacacacccccagcactcactttgcctctcagaaccagccttctgactcctcacctcggtctgcagggaagcgcaacaggaaaggagagaattgcaagggcctgcggcatttctccatgaaggtctgcgagaaggtgcagaggaaagggaccacttcctacaacgaagtggcggacgagctggtagcagagttcagtgctgccgacaaccacatcttaccaaacgagtcagcttatgaccagaagaacataagacggcgcgtctatgatgccttaaacgtgctgatggccatgaacatcatctccaaggagaagaaggagattaagtggattggtctgcccaccaactcggctcaggaatgtcagaacttagaggtggaaagacagaggagacttgaaagaataaaacagaaacagtctcaacttcgagaacttattctacagcaaattgccttcaagaacctggtgcagagaaaccggcacgcagagcagcaggccagccggccgccaccacccaactcggtcatccacctgcccttcatcgtcgtcaacaccagcaagaagaccgtcatcgactgcagcatctccaacgacaaactcgagtatctgtttaattttgacaacacatttgaaatccaaggtgacatagaagtgctgaagcggatgggcatggcttgctggctggagtctgggagctgctctgctgaagaccttaaaatggccagaagtctagtcccaaaggcgctggagccgtatgtgacagaaatggctcagggaactgttggaggcgtgttcatcacggcggcaggttccacgtctaaaggcacgaggttctctgccagtgacctgaccaacggtgcagatgggatgctggccacaagctccaagaggtctcagtacagcggctccagggtggagaccccggtgtcctacgtcggggaggacgacgaggaggatgatgacttcaacgagaatgacaaggacgactgacgtcctccccacttcaaattcagcttcaggaaaacatttagggaaaagaaactttttttttaatgtaggttttctgtttccttttgtcctactcccaagaagatattggtaagctatttaatttagatatgcacctctgataagcaaggattgtttcctgtaggattaggacgtgctgtggatgtgtgttttgataccagtgtgctgatgcagagcgtttatttactttttagtattttgtgctttcattttttatttttcttttaagtgcagagttcatttttgcccctgaacagtttttgctgagtttgctgaagaaattgtatttcatccacatgcatgaaaataaaacgccctcttgttgtggatggtgagcacctgatgccgtttatttgccgtgagtttggacggcgcccccactggcagatagcgagactctgtggagttttccatttgttcagtggtacggtgtccagagccccaagcaaacagcagaattcgacattttaaacaataaacaccatcaaccttattaactttattttctcttaaattatattgactgtcgtgattccatcaagtttatacactcttttctctccctattttgcagcaacaaattgcaaagtgcttttgtttgtttgtttgtttttgtttggttaaagcttactgccacgctggtgtggctatggagactgtttggaaggcttggaatggtttattgcttatggtaaaatttgcctgatttcttacaggcagcgtttggaaaccttttattatatagttgtttacatacttatcagtctatcatttaaagacatatactgaaacaaatgtatttgtttcataagcatcttcctgtaatctattataaaattgaaattaaatataaagaatgttttaacaattttttaactcaaaatttgtcaatcatttttaatagttcttttttttttaataaaaagaacaaggaatttaaggacaggcagtagtctcttttaaaatttattcacaaaacccattaactgcacagttgctattagctgcctgttctaaagcgaaagtctttttattgaaacacaaataaacttttctgtaatattttatggaatataaagaaactttaattgtttgacttgtttaacttggcactgttagtttttattaataaaatacgcatgggcattttaaacaaaaacaaacaaacaaaaattaccctgttaggaactctgaaatatgcttttaactaataatattatgttggttggagagctaggctcactttcctgtgtgctgtactgtctttgagagccccatttccataggacgctgctgagctaggatttatctccttggccagggggaaggatttgattcacacagttttgttctagaag

SEQ ID NO: 465938 - DNA, 1396 bp, Homo sapiens
cgaaaaaccatggtgtgcttgggagcctttgctggtgtagggtgcctgagcacagggttttggggaactaggatggtgagtgggaccatcaaccaggacagaaaatctggaaggagggggagtgagcttgagggcaagagttcatttctagacttgttgaatgtgaatgcttgtgcagcattgaagaaacgtctagtgctggatatccagtgtccagctctggagaccagaggaaaagagaggtcctgcttggttaacccactctcagtcctggccacttcccaaaggcacctggcttaccagcctcagaggctcctagctccattctctcagcctgcccagagagagcctggtgtgactgaaggaagtgtggacctgggagataggaaccgactgacactgctccctgatgtttgtgcttcagggactgtgctggctgatgggaaccctgcatctgagagcgcgtgcgctgggcgggaggcagagccaaaaccgtaacagccagagctagagactccggcctggggttctggctctgtcccgtatcagctaggaaacccagggcaagctacttaaactctcagaggctcagctttttcatgagcaaacaggaaaacagggctaatgattagtccttggcttaaaatacataccgcgtgtgaaattgcaggtatataatagattcactaaatgagagggcgagttatcaacacttactctccaatgcgtcatcacccccaacactcctgtgtatttcctgcaaataaggatcttctcctacatggtcagtccgaacaaccttcagtcacaactgagaaggtcacatggtgcatcactgccgctcagtctccccaagcccagtgatttcttcacaattagggatctgagacccgcagtatggcagtgacaagatccaagtcttgggacacctagccaggagggaagaatttgagggagaggtggaaaatatgcgaggctgaactgaccttcaaggacaagaaggctgtgttcagatagacagagtttgtcttctgggagaggagtgggcttatccaggatgatcccaaaggcagattgaggaccagtgggaggacatcctgagaaagcagatccagctttaggcaaggaaggacttcgtaacaggcagagagcccatgttggaaacaagcagctctgcaaggtgtgggcccactgtctgactccctgcggggctgctgccttggaagagcctcctgcttagagaggttctcctgccgccagctgtctctcctgagtcctgagcaccacatctctggaccgtctggagcctcccctcccttggcttactgctcccaccaccctctctctccaccttgcaagagacactctccctcatcctgggtcatcaccctcttta

SEQ ID NO: 465939 - DNA, 1360 bp, Homo sapiens
accatcacactgctagcaggcctgctactctgggctcctccagctaatgtcattcacttctttctccaggaaaataagccattggggtgggctgctcacgatgttgaagtaacagatgatcaccttctgtcaaattcactctctcaccctccacattgcaggggctcatcagcttctctttgacgtccatcccagtggtgggaagcaggagccacatggagcaaattgcattgttggaaagcccacagaatctgctcagggaagcctttcttcaccagccctgcctgccactctcccatcctctcctcaccaatcaagcgaggtcaggtctggttttcctgaaagagaacctcacggcctcttgtgcttttcctccctgacttcctcattaccaccttgtttgtgctctccaccaccttgttctcttctcgccttagggcttcgtaccaatcgttcccccggtgaacaccgtgttgcagatctcctggtggtcagttgctggtgtctgtccatcaccagcttaaaaagcatctccctgtggagtgctagttcagaacatcaccccgcagtcaccccacgctaaatctctggactcatggctactctgtggaggggacggtattgctgcaggagccatgcttatcaccttctcacatatatttataatctaccacaatgtcttgctggaaaaaaaaaatgggacaacataatttccccaacttaacacaacccctgcctggaaaatgcaagccaaacttaacaggcaagttcggcagctgcttggcgtcattttgttttaacatcatgcatataaaaaaagaaatagtgcaatgctggggggaaggagaattttcaattgcttagatttgataaagaaaaactagtgatcaaaaattatttttaaaaataacaatgacttcttggtaacatattttcccctacggttgtttgatttctgaacagacaccttttattgacgtctggctgatttccacaaatggcatgtttctgcttttcccacattagggaagctggttctttggcccaaagtgcttttacagcctacctgtattttaccggccctcctagacggggggaactcccctgtcctctgcaggaatgtcaaaagccacccatctttaaccacctaatgctcccatcagcagagaggcacacagcacagtgaacgtcgagcatgcacaccaggaagcccaggttcgagttctgaccgtcacttactggtggtaatgatggtactagatgtcagagtcaagggagctgaggaaggcatccaagtaaggaggtggcgtgggcactccctgacaaggctacacgagtgcaggccaggtgaggacagtgt

SEQ ID NO: 465940 - DNA, 447 bp, Homo sapiens
gaccaaggcccccaggaacttcctgttctaggacacccccagcaagtcagggcccctcctgaccagggaccaaggcttcggagaagactctggagaaggctcggaggaaactgggaagctggttctttggcccaaagtgcttttacagcctacctgtattttaccggccctcctagacggggggaactcccctgtcctctgcaggaatgtcaaaagccacccatctttaaccacctaatgctcccatcagcagagaggcacacagcacagtgaacgtcgagcatgcacaccaggaagcccaggttcgagttctgaccgtcacttactggtggtaatgatggtactagatgtcagagtcaagggagctgaggaaggcatccaagtaaggaggtggcgtgggcactccctgacaaggctacacgagtgcaggccaggtgaggacagtgt

SEQ ID NO: 465941 - DNA, 554 bp, Homo sapiens
tgcaggcgaactttaaagaatccccttcgtggatcccaccagggggcatggaaaagacgtattcacctattgataaacaggggcatttgtgcaaatgctctggcggcctatgcactgggcgaagagacctgaaccatcctattaaaaccgtgtctgatctaggactcactcttgacgcaacttctgctaagctatacgacttccaccgtagcgcacaatatcaaacttgaccaggtccctgaacttgacgtagttggacaaggggatcttgttgacattgggtctcttctttacggtggtcatcccacggtctcatgtaatgatgacgctgaggtgctctgcaggctgtgcttctcagtggctcccaccagatacccgatggtcctgtcgatttgctgaatcatcaacttccttttctctgcctctggcccgaatcgatgtcccacgttatctggctctctgtagcacagagtcacaaaatcaaagtcttccttggtgaaccagttcatgacggtatcgatgttctccttccgctctgtctcgttgctgcttgg

SEQ ID NO: 465942 - DNA, 1869 bp, Homo sapiens
cggggctgggctcaggggccgagacctagctgggcttggggcggggccgagacggagcgaggggtccagggtgtgggaaacggggaggggtttgaggaggggatcggaatgtggctcaagttcgggaggcgttacctgcggagggtttgaggcaggcccaggagcgagcccatggtcttccgacgcggggccaggggcgggccccaggatccggagcttcgtgcggggccgagtccaggtttggggcccgggaggcggggccagttagggcgagggtccctgggatcgtcgggtcaggccttgggctaacgtaggcactctcgcagttcctccgccttcaggaaggtcttttcagcaggggccttacgggtgcatgcttcggtcctggaggccttatcctagcctcctctccatcagcgccacccgtctggggcccgaaaggagggagctttccctctgtcccccagcctttggactgtcagcaaacaagccattcgttcatcaaatactttttaagcgcctaccatgtgcctgacaagggagatgtaacggtgagaaaaactaggtgtggtccaggcccttcaggggctcaggtgctcgtggaagaagtggacattgaagtacttatcacacaaatgaggataaaagtacgatagcgatatctaccacgaagctgttgttccccaccagaaccaaatgagcgcaagatctgacaaagaaaaaaaaaggttcatcttttattcctccaaacactttcatttaaatcaagaggatgggatgtggttattgctgtgtttttagacagaatcaacggtttctgggtctgagatgttgcatacaccttctcagtccctgtatcctgagatggagtcacctgagaatccacagcaactctctgcctgaaggagacaagaaaaaccaacgggaacaggttagttatactgataaatcctgggcttattttattaactcacataatagctattgtctttcctccaaggagcaaaagggcatatacggtcaatgccatatctttgaaaatttaaactacaaggacactgctctctgtggtggtggagagaataccaaggatttaaaggtctttaagaaagagaatgtagaaagcgtacccattggaaacagcacgatgatgataatcttcttaaaggctgcgtgtccagagtttgttccttctgatgctcggatgtgttcagagtttcttccttctggtggttttgtggtctcgctggcttcaggagtgaagctgcagaccttcaaggtgagtgttacaactcttaaggtggggcgtctggagttgtttgttcctcccggtgggttcatagtctcgctggcttcaggagtgaagctgcagaccttcgagaacccggtcatgtttagcgatatggaagtgttctggaaactcctccttcttgtagacgtggaggtgacggtgcgcattcttcagtgcctggtaaagggcttcctcttgccccaacttgggcaggggcatcccaaagccaccgtagcgcacaatatcaaacttgaccaggtccctgaacttgacgtagttggacaaggggatcttgttgacattgggtctcttctttacggtggtcatcccacggtctcatgtaatgatgacgctgaggtgctctgcaggctgtgcttctcagtggctcccaccagatacccgatggtcctgtcgatttgctgaatcatcaacttccttttctctgcctctggcccgaatcgatgtcccacgttatctggctctctgtagcacagagtcacaaaatcaaagtcttccttggtgaaccagttcatgacggtatcgatgttctccttccgctctgtctcgttgctgcttgg

SEQ ID NO: 465943 - DNA, 996 bp, Homo sapiens
agtccactctataggatcccctagcgtatggaataaattataagtcgttggggaaggaacagattatttgatgaagggggttgtgaaattgggtattttaaaaaatctatttatatctttgctttggtgacacaccaaaatatctttcatacggattggatttaagtatatatatttaaagctctaagcgagaaaaaaaatgtggagaaaatttgatctctgagaaagaggattttttttaagcctaaaagccaaaaactctaagtgattgctcaacttaagtacataacagtattcattttactgaagaattacaaataactaataatgatcactagaacagaaaaatgtcaaaagaaaaaacacacggtattcattgtcctcttataaaattaagaaagatttagaaaatgcaaatactcagtgctcataagaatatggttagattttcaacactttctagaaggaaaaatgttaaaataaattccaaagaaaaaattttttaaatggtttggtttttacatatactggggaaacttactatttaaagactagagttaattatttcaaaataaaaatagtctttctaattttagtttcataatgttggtttttaatctttgtttgattttaaacaaccttttagtctttgggctgtccaaaattataaattatatgtctgtaattcactattgttaatcatacagttctccatataaaaaatggcagagagataaactggaaaaatatgccctgtgaaggggatttatgatccttaatatcccagaggaagaccataatgaggcatcttatgtaacagagaagtcatatagggcttcagtttctaaagtgctcaaattttaattcatagtgtgactttgaacaggctgctttacctctcttggtctcagtgtcttcatctgtgaaatgggagggttgggttagatcagtttcccagctgagatgcccccgcacagctgtgccaaaattctgatg

SEQ ID NO: 465944 - DNA, 2100 bp, Homo sapiens
tggtttaatccgttggtattagttatctcccagccagttaggatgaactttggctctttgtacaccaaaaggcagcagttctcttgtttatttcagatgagcgttgttgctcctcttgttggcaaggcccctgaagctgacccagtcacacagagccccaccagccctgtcattaaggtttatagcaagtccagtcaagccactgtgctgttggcatacctgctggtggggatccagttgtccttggccagcgtggaacttcctcaggagtgccaaccggccccagaatgccctggcccatgggaacctgcacttaaagatgcagcaccaacaggtgtttacccagctcctgacctgagctcagcactgcaaagaagtcggggcttaagtgaccagtgtgacaagaaccctgaaacacctaatgtacagaaggactctaggtccatggtccccaacctttctggcaccagggactggtttcatgggagacagtttttccacagagatgccacttcatctagctgctgtagctcggatttcttcctcacagataagaggatggaggttgctcttgatatgggaaatagaaggatggaggttgctcttgatatgggaaatagaagtcggagtaggagtggcaagtcccagggcctcttcgtgcaggctgttcaagggggtctcataacctaccagtccgagttagacttgttgagtcttaaaaccaagctgctttgagttgggtcttcagatgaactgggaatcaacatatttgggatggatctgtagggtgcatttaaaaggcactgaatgtttggaatggagtgcaagaattaatgttaagttaccagagaaaattgaggtattaagggatctgcgcatatagttttcaaaaatcaattaaacaaaaagcctgttttttaactgattctatagttcatttggaagactatgtatattacattatatcatatatctacatgtgtgatatatttataatagaaaaatgaagcagaaacttctactaccaaatattaaaacacattataaagtgctgataaaagatgatgatgtgggcataaaaacatgcaaataatccaacaaaatagcacttttcaaaactttttttagcgtatggaataaattataagtcgttggggaaggaacagattatttgatgaagggggttgtgaaattgggtattttaaaaaatctatttatatctttgctttggtgacacaccaaaatatctttcatacggattggatttaagtatatatatttaaagctctaagcgagaaaaaaaatgtggagaaaatttgatctctgagaaagaggattttttttaagcctaaaagccaaaaactctaagtgattgctcaacttaagtacataacagtattcattttactgaagaattacaaataactaataatgatcactagaacagaaaaatgtcaaaagaaaaaacacacggtattcattgtcctcttataaaattaagaaagatttagaaaatgcaaatactcagtgctcataagaatatggttagattttcaacactttctagaaggaaaaatgttaaaataaattccaaagaaaaaattttttaaatggtttggtttttacatatactggggaaacttactatttaaagactagagttaattatttcaaaataaaaatagtctttctaattttagtttcataatgttggtttttaatctttgtttgattttaaacaaccttttagtctttgggctgtccaaaattataaattatatgtctgtaattcactattgttaatcatacagttctccatataaaaaatggcagagagataaactggaaaaatatgccctgtgaaggggatttatgatccttaatatcccagaggaagaccataatgaggcatcttatgtaacagagaagtcatatagggcttcagtttctaaagtgctcaaattttaattcatagtgtgactttgaacaggctgctttacctctcttggtctcagtgtcttcatctgtgaaatgggagggttgggttagatcagtttcccagctgagatgcccccgcacagctgtgccaaaattctgatg

SEQ ID NO: 465945 - DNA, 1251 bp, Homo sapiens
cagttctcaacacgggcctcctgctcggaggtgatgtgattcagaccgcggctccagggtctccaaaatttccgcgtaaccaggaaccgcaggtcgaaggccagtaccgcatccaacaccgccatctgctgtgtttgtcaaatagtcttgtttttatgtggttttgtttttacaaccctttaaaaaacatcaaagccattctgacacgagggctgcatgcagccgggcagcttctgccggaggctgtggcttcctggctccttccctagagctgtccctcacttcgcctgcatgcccagaaacacattttcttatgtttccaaaataaacatgtcctgggccgtagtcacagctgggcatggtggagacacaggggacggagcaggcggcactgaagactcttccctaagttggaacacacaggacttgagtacgtgctcaacactcggtgttgtacattctggaaacacgacctcacgcagcaatcgacctcccaccactgcctcgtgcgatgtcacagagctagtgagtgcggctggcgaggacacatgcttggccgtggcaaccgcgtggcaccaaccagcgccgaaggggctgggggctgagtgcagaccccgaagaaggactggctcctcggtgctgatggctgtccttctaaaccagaggggagtccaaaagcttcagtgcaggaggaaggcagtgagtgttagccctgacctgcgctgagccctgagaagaaagcttccttcgcccgcgtcctcccgctggctgagtcagccaggaccctgctgtgcgaggtccatatggggcaggtgcagctgccaacacggccaaactgaaggttcgctcgcaccaggaccagtcgtgggtgaactctttgcacgctcttgacgtcaggtctttgtggactcagtgggaactgagaacaattccatccgtacgacgtccagatgaaccttgctggtcggagaggaaacttctgaccaccccgagctgagctttgtgttcctcaggccccgaaacacattctaggagaacatctggatgactttctgtatggcaatgactttttagatataacacgaaaggcacaattgatgaaataagtaattgataagccagacatcaataaaattaaatatatctgctctacaaaagacaagatcaggagaatgggaaggcaagccacagactggaagaaaatacttgcaaatatacatctaataaagtacggctgcccgcagaactctt

SEQ ID NO: 465946 - DNA, 1129 bp, Homo sapiens
  misc_feature (2)..(2): n is a, c, g, or t
  misc_feature (7)..(8): n is a, c, g, or t
  misc_feature (10)..(11): n is a, c, g, or t
  misc_feature (13)..(16): n is a, c, g, or t
ancatgnntnntnnnngggtgacaacaaaaaaatggaagatgctaaattctacctgaccctgcctggaaccaagatggagatggaagaaaaagagcttcaagcatctaaaaacctggtcaccttcaccccaagcaaggatagcactaaagacagctttcagattgccaccctcatctgctccacaaagctcacccagaatggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaaggtcagcctggcagcatcatgggtaactcttcttaggctgtggtaaggatgttctgggaccgcttagaattggccatcatgagggagaaacaaagtgaatcatggttcatgcatagcttatgaattttagtatgatttacagaaaataaaggaaaaaaaatccattttaacttctacagagcttgtattttcaagtgtcaacttgccaaagacaagctacccaattagacatcccttgaaaggccattgtgaaccctgtttgaccccatgatttcagcaaactgatcccaatgcactacaggtgacaaatttttattttttgtccctcattttacccagaagtgcaaagtcaccatctttattatcataattttttaaaaaaatatgaaatatataatccctgaa

SEQ ID NO: 465947 - DNA, 1277 bp, Homo sapiens
agccaccccgtcccagggaggaagagcactcacagctgctgctgatctccttccagggcttccgctgggactaggatcaggatgtggacacccccaatctggaccgtctagccggggagggcgtcaaggccaggtacctcatgccaccctttgtcacgatgacctcccggtcccgcttcaccgccatcccgggtaagcgccactctgcccatttcacccggtgcccatcaaagccccagcgtccgtcattcctggaataagaagcagagctcggtcaggagttcaagaccagcctggccaacatggtgaaacgtcgtctctcctaaaaatacaaaaataagctgagcttggtggcagacgcctataaccccagctactcgggagtctgatacaggagaatcacttgaacccaggaggtggaagttgaagtgagctgagatcatgccattgtactccagtttgggcaacagcacaagattttgtctcaaaaaaagaaaaaataaaagtaataaaaataaaaagatcacaaaggccttttgcctgtgccttctgccctgctccctccagccccagggacttggcctgtgctagtccagtccctccagctcactaggagcatgcagtccagtcggggagacagacaacagacaccctaacaggcacatacatcccaggacaactcgggaggcaccaaggaggaaaacgagttttccaggcacagactacagggtctacagctcccagcatgagtgacacagaagacaggagatttctgcatttccaaatgaggtacttggttcatctcagtggggagtgtcagaaagtgggtgcaggacagtgggtgcagtgcactgagcatgagcccaagcaagtcaaagaaaggggtgacagatggcacctggaaaatcgggtcactctcaccctaatactgtgcttttccaacagtcttagcaaatggcacaccaggagattatatcccgcacctggctcagagggtcctacattcacggagcctcacttattgctagcacagcagtctgagatcaaactgcaaggaggcagcaaggctgggagaggggcgaccgccattgcctgggcttcagtaggtaaacaaagtggctgggaagctcgaactgggtggagcccactgcagcttaaggaggcctgcctgcctctgtagactccacctctgggggcagggcattgccaaacaaaaggcggcagaatcctctgcagacttaaatgtccctgtctgacagctttgaagagagtagtgg

SEQ ID NO: 465948 - DNA, 3787 bp, Homo sapiens
  misc_feature (3323)..(3323): n is a, c, g, or t
  misc_feature (3329)..(3329): n is a, c, g, or t
  misc_feature (3332)..(3332): n is a, c, g, or t
  misc_feature (3336)..(3336): n is a, c, g, or t
  misc_feature (3359)..(3359): n is a, c, g, or t
tccttcagatagcagtgagaagatgtgggcaacaacagtgtccctgacttgtcaaaagcctgagtgattccctctaagttacaaagcttataagagacagaaccagtcctgaagtccattccttttttcactataccagattgagaatatcacccactgtatctcacagtatcatcttgaacatcagttgagatgatgaacatgaaagcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagagagacaaattcgagctcggtacccgtttcctgctttccttttcactgaaggttttgcagatcatcccagaaagcatgtttacatctcttctaaagatcataaagcttcagacccacgacattattgaagtgcctacccgcctggacaaagacaagctgagggactatgctcagctaggcccacgatacgaggtgctgtgtccctctgacttctgccttttcatgttaaaaactaacagtcatgaaatatcacaggcctgtgtcacctgccatattctggggaccaccagaccaattctgacttgttgtctcacatttgcaatgcgggctcttgcgtcatcagccgtcgccggcgagtggtcacatgatgcccctccctgctcccagccgcttcggtcatgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaanatggantangganagagctgtgaagcgcgtgccttngccctgataggggactgatattcaaccctcgagccaagccaagtgaattgatgcccaagctgaaagagtgggagcgaccatggatggattccatcgttctttggaatacatacaggactatgtcaacatttatggtctgaagattggaggaagaagtatctcgtatcatacattacaacgtggagcaagagtgtaataactttctagaacgaagatcaagatggcaagcatgtacagtccatcatatccaataccagttacccggggatgactcgcacgtatggcgctcgcagaaatcgcgtacggccaaaggtgtctaccggacctggtgactaactccgcagggaccgcttactaccctggacggcaggacaagcgctagaacaccacaagcgaacagcaagggccaggaatcccagtagacgtga

SEQ ID NO: 465949 - DNA, 3477 bp, Homo sapiens
  misc_feature (3013)..(3013): n is a, c, g, or t
  misc_feature (3019)..(3019): n is a, c, g, or t
  misc_feature (3022)..(3022): n is a, c, g, or t
  misc_feature (3026)..(3026): n is a, c, g, or t
  misc_feature (3049)..(3049): n is a, c, g, or t
tccttcagatagcagtgagaagatgtgggcaacaacagtgtccctgacttgtcaaaagcctgagtgattccctctaagttacaaagcttataagagacagaaccagtcctgaagtccattccttttttcactataccagattgagaatatcacccactgtatctcacagtatcatcttgaacatcagttgagatgatgaacatgaaagcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagagagacaaattcgagctcggtacccgtttcctgctttccttttcactgaaggttttgcagatcatcccagaaagcatgtttacatctcttctaaagatcataaagcttcagacccacgacattattgaagtgcctacccgcctggacaaagacaagctgagggactatgctcagctaggcccacgatacgaggtgctgtgtccctctgacttctgccttttcatgttaaaaactaacagtcatgaaatatcacaggcctgtgtcacctgccatattctggggaccaccagaccaattctgacttgttgtctcacatttgcaatgcgggctcttgcgtcatcagccgtcgccggcgagtggtcacatgatgcccctccctgctcccagccgcttcggtcatgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaanatggantangganagagctgtgaagcgcgtgccttngccctgataggggactgatattcaaccctcgagccaagccaagtgaattgatgcccaagctgaaagagtgggagcgaccatggatggattccatcgttctttggaatacatacaggactatgtcaacatttatggtctgaagattggaggaagaagtatctcgtatcatacattacaacgtggagcaagagtgtaataactttctagaacgaagatcaagatggcaagcatgtacagtccatcatatccaataccagttacccggggatgactcgcacgtatggcgctcgcagaaatcgcgtacggccaaaggtgtctaccggacctggtgactaactccgcagggaccgcttactaccctggacggcaggacaagcgctagaacaccacaagcgaacagcaagggccaggaatcccagtagacgtga

SEQ ID NO: 465950 - DNA, 487 bp, Homo sapiens
ttggaggtggtctagactttgtccctgaatttctgcaaagtatcagtgcctgaggagatgacatcagggtcaatgttaatttatagtgtagcttcttatttaaaatttaaattgggtttcctcaagctctcttcataagctgcctagtctggatttttctcttaagtaaataaatattttctgttgcttcaacagatgttcaagcaaatgctttcagaaaagcaaaccaaatgggagcattacaagaaagagggttcggagcggatgactgagcttgctgatgtcttttcaggagtgaaacccctaaccagagtggagaaaaatggtaattactgaagaggaaatactggtgtgtttggaatgtgtgcacaggttatttgaaaccttggaaactggcaggttaaaaagactttatgttctcattattgtatcctatgatattccatctttagtgttgctaataaagatctgaaggttaaatttggct

SEQ ID NO: 465951 - DNA, 2063 bp, Homo sapiens
tccttcagatagcagtgagaagatgtgggcaacaacagtgtccctgacttgtcaaaagcctgagtgattccctctaagttacaaagcttataagagacagaaccagtcctgaagtccattccttttttcactataccagattgagaatatcacccactgtatctcacagtatcatcttgaacatcagttgagatgatgaacatgaaagcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagagagacaaattcgagctcggtacccgtttcctgctttccttttcactgaaggttttgcagatcatcccagaaagcatgtttacatctcttctaaagatcataaagcttcagacccacgacattattgaagtgcctacccgcctggacaaagacaagctgagggactatgctcagctaggcccacgatacgaggtgctgtgtccctctgacttctgccttttcatgttaaaaactaacagtcatgaaatatcacaggcctgtgtcacctgccatattctggggaccaccagaccaattctgacttgttgtctcacatttgcaatgcgggctcttgcgtcatcagccgtcgccggcgagtggtcacatgatgcccctccctgctcccagccgcttcggtcatgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacaggtattgatctatttaggaatagcttattctggtagtaaatagtggagagggaaaaggacacatagcaacgtgtaaatctctctgagttactacaaaatttcctaatttagtttatactgtatatagttgtcttttcctacctgtggcactggtcatcttaagaattttgaagttttactataatgtcctgctcttacgaggtgttgtaataaacttagtttaactaagtcatatagtttccaatcctgttatttattatcatatcctagtgtattatatgtgaaaagtgggaaaaagaacttatctttatcattaactttctgtctcttaatacacttcttaagaattcattactcattaacttttagactagatattccatgttcttctgcctttactcctagatacttgtaattcacaaatcaggactagggaatatttcttttacttggaacagcgataaatatcaaactgtggccctaaatcagtttataagactgtattcttaagagcatgaaggaccatgaact

SEQ ID NO: 465952 - DNA, 3733 bp, Homo sapiens
  misc_feature (3269)..(3269): n is a, c, g, or t
  misc_feature (3275)..(3275): n is a, c, g, or t
  misc_feature (3278)..(3278): n is a, c, g, or t
  misc_feature (3282)..(3282): n is a, c, g, or t
  misc_feature (3305)..(3305): n is a, c, g, or t
tccttcagatagcagtgagaagatgtgggcaacaacagtgtccctgacttgtcaaaagcctgagtgattccctctaagttacaaagcttataagagacagaaccagtcctgaagtccattccttttttcactataccagattgagaatatcacccactgtatctcacagtatcatcttgaacatcagttgagatgatgaacatgaaagcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagagagacaaattcgagctcggtacccgtttcctgctttccttttcactgaaggttttgcagatcatcccagaaagcatgtttacatctcttctaaagatcataaagcttcagacccacgacattattgaagtgcctacccgcctggacaaagacaagctgagggactatgctcagctaggcccacgatacgaggtgctgtgtccctctgacttctgccttttcatgttaaaaactaacagtcatgaaatatcacaggcctgtgtcacctgccatattctggggaccaccagaccaattctgacttgttgtctcacatttgcaatgcgggctcttgcgtcatcagccgtcgccggcgagtggtcacatgatgcccctccctgctcccagccgcttcggtcatgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaanatggantangganagagctgtgaagcgcgtgccttngccctgataggggactgatattcaaccctcgagccaagccaagtgaattgatgcccaagctgaaagagtgggagcgaccatggatggattccatcgttctttggaatacatacaggactatgtcaacatttatggtctgaagattggaggaagaagtatctcgtatcatacattacaacgtggagcaagagtgtaataactttctagaacgaagatcaagatggcaagcatgtacagtccatcatatccaataccagttacccggggatgactcgcacgtatggcgctcgcagaaatcgcgtacggccaaaggtgtctaccggacctggtgactaactccgcagggaccgcttactaccctggacggcaggacaagcgctagaacaccacaagcgaacagcaagggccaggaatcccagtagacgtga

SEQ ID NO: 465953 - DNA, 1139 bp, Homo sapiens
cggctgatggcaccataccatttcagctttctccctgtctgctgctatcatgggtaggatggaaggagcatccctgggagctgcggctctaggcgctggcacaagactggggggcggtgcttctctgagggcacactcctcagcctttgcagctgacttatgtcagcaagctgctgcttccccgggaccaggcctgcccttgggctctggtaagaagagctatgcaaatccagggagctctcccaacactctacagcacaaagcctctgcaactttcacatattcaaactctatgcaggggtctaggcagaatatgaactctcaaaggctcattgttagcttggagaaaaaaggttacgaaaattatttttatgttccagtaacttacagttgtttcaagagagtgaagcccaaagaaataaagaagatccccattctggtagaaagctatgctaagaactgagttcttcctattgcaaatgtcagcctatcattcatttcatataatttcctaagatcgtcatgagatgcttagaacttttctgtcctaaatttatataacaatgttaaagccctcaactcaaatgttacaggtataaacatatacctgtatatgttacagtaaattgtttctaaatgagaacaaggattctctcaggagtatgtgcaataatttatcattatgttggcagagacttggagaaatataagaagtgaaaaggtcttcactttaacctgaatggctttaccataggatcaagactaccttttcatgttcattagtcatatgtaaatactcattcaactactatcctttactatcttgcaggcactgtatataaactgttgaacaaaaatgatcgctcccttcaggagatacgggtcacacatcaacatttaagtacaaagggtgacaaatggtgtaccataattggaacatatgttccctgaactgacagtactctgtctctacagcacagtccctatgaattaagatacttacagtgatgaggaatggtatgctggaaacagttttgctattttcttcaaattagctgaagtcatgctatgtctcaataaattatttctttcatcacatagcttatgtttaatactctcagactgtagcagtatgtatg

SEQ ID NO: 465954 - DNA, 1993 bp, Homo sapiens
gtggattgtcatcatatttgagtgcctagcatggtgttaggtgctggggatgtagcaacagtcagcaagggcagagtctcagtcagctctgtagagcttgtgtgctgtcatcataggtactttgagaaatgcaaaggtagaccaggtgttgccccagtacacactgacctgaacttagcatcccggagaatgaaagggacagttggggcagtggggcagcttccccccgagaagacaagcgtcttctcctctgggttcatggttcccaggtgggaattcagggcgggggagttgtatcaatatcactttaaatcaatggaaagtctaaacatagggtgctctagggttgctccatcaagcagcccggcagtcttagccgcatcctgtgtctttccatttctctttggcgtccctggtgtgtgcttcagcctgagccaaatgctcaccttgctctggggaagccatcatatttgagtttttaaaaatcataacagtatgtgtatatgagtgtgtattataagtgcgtgttccttgtgtacttacaaataaatttataatttttcaaagttatctggcggtattgctttacattttgaaagagcattacagttttagaaatgactatttatgtcattggatcagcaaacaattttacaggatgcagaaattatcgattgtattctgtatgttagtgacttactcgagatgctagagctgtcagaatgaacttagactaaaacccaggtcttctgactctatgtccatcaccctacccatgatattgacttgtagatgtcttgcccatggcatgaatcttagggaaaggtgaggagctcctagaagtagctgtcaccagaaacgggccaatgaacttcctggtccaagtcttctgtttaaactcccagttttaacattgagcgtctgctttgcaatgaacatgaaacaaggaatttgcagcattgagggtcgtacgcttcactgacttgaggtcagtgttgctggatgagcctgtttactgctgggggcagggtatgtatccccatgagtcaggggcttgattggtaggggaggtcacagaagccttttgattttgtttttcttcttttttaatgttaagacaggtaactgactagggctgcagcattttttcatgtttacagagcatcaagcatgattcaagtagttgctggaagccgccaggtcaaagtgtgcagagaacaaataccagtatgaggggagctacataaacatatgcacacatattaaacataagctatgtcatctgtagaatttaataaactaggctagatttaaaatctttccctttgatgtgtaatacgtcatggttttgaacattttcagaaaatggggccacttctcagttactccagataaaacttactcttcaaatatgacagcattttcttcaccaatgtattttcttcactcatttttcaaaatccctttattgaccctgggtgccagatgagtgcaagttggggcacccatacaaacccacattttaaacttctttgtttgtttcagggaaggtttgaaatagtgtaaattttctcttagtccaagaataggctatttccagcctgagctatagtaccttgttaaactcagtgaaagctacacctttcaacttcgtaagcttggttgccaaaatgtagttcgtttggaatgaattattagaatatcacacacacacacacacacatacacacacacacacacacacattcaaatgtgattatctactggaaagtcagtagataaatcagttgactagaaagtttatggtttgtattatttttgtaatgttatttcatatttcccacccttatattcccctctttgagaatgataatttgagaagttagctatgtattagccttagtaagaaactgtattatgtttatcagagaatgaaacgaaacaaattattcctcctcttttagctactcccctcccccgccccacacacttt

SEQ ID NO: 465955 - DNA, 848 bp, Homo sapiens
cagatttcatgttgttcaaacacacatgctttacaaacaatttgtacaattaacacaatcatcacagggtcctgaggtgacatacatcctcagcttatgaagatgacaggattaagagattaaagtaagacaggcttaagaaattataaaagtattaattgaggaagtgataaatgtccatgaaatcttcacaatttatgttcttctgccagggcttcagcgggtccctctgttcgtggtccctggcttcccgcaacaaactgtccactgccatcagattatatttgtaacttttactgatgctcctttttttcatgttagaatgagatagaaaaacatctcctgagagagacatttgaggactccaatctgatactcaaagagattctctggtgaccaaaagaagtcttcagtgatggaataacttcagttaagaattcctggtttaagattttacagaaatatgttgaacatcaggtatattgtctttaaaaacattttcaggaataggacactttggatgcagagctgtcattgctgttcattttgtatttagtttgaatgctttgtccctttaagagagattcatagtctctggaaacaattatctcttttataagaattatataagaattaagtagcatgaaggattataaagtaccatctggaattgaaagagagaggagacttactactaatcatcactgaccttcatttaacacatttttgggcaccttctgggtgccagatcttgttaggcacaaattactgaaacagagccaccaagaattaaaaatatgcatatgaatgtttcttaaaagtcactgcagctatgcatattatgaata

SEQ ID NO: 465956 - DNA, 1737 bp, Homo sapiens
ctttgcaataaaaatattattagtgaatgtacaaggagtgtaatattttggttttgctagtggttcttaaggtacaacagcattttgaatttgaatatcagaccaaaatggatggtcttgttacattgaagcacttcaagactccctttttaaaagtggagccctttcttcctggacactatgaagtttttgatttaaagccaaatgaccaagttgcatccgtggtaatggttaaatatcatcactgtcgggatgaacccccacacgtgctctattacaatgtggagaaactctttccagggcttggactccagcttgttgctgctaccctgttgaagcagctcaaagaggcccaagtacagtatcctctccagacatttgtaattggcatggaagacagccctgatttactggctgctagaaaggtggcaaatcatattggaagtgaacatcatgaagttctctttaactctgaggaaggctttcaggctctggatgaagtcatattttccttggaaacttacaacattacaacagctgatgcttcaggagaggctgatcagataatgaaggccgtgtgggaaaggaaggttgaggaagaggtggagggtcgtcagattcagaaaactgtggtaactgcagggggtaaagggattgtgtcagccagtctgagaaataaagagaaagagtacaagaaagaaattttacagctgggccactgggggtgacatcacatttcagtaggttctgtgatgccccctcagccacaaaaccagcaagtttttattaggaacttcaaaaggggaagggggtatgaacagggaggtgccctgatttcatattgttcaaacacacatgttttacaatcagatttcatgttgttcaaacacacatgctttacaaacaatttgtacaattaacacaatcatcacagggtcctgaggtgacatacatcctcagcttatgaagatgacaggattaagagattaaagtaagacaggcttaagaaattataaaagtattaattgaggaagtgataaatgtccatgaaatcttcacaatttatgttcttctgccagggcttcagcgggtccctctgttcgtggtccctggcttcccgcaacaaactgtccactgccatcagattatatttgtaacttttactgatgctcctttttttcatgttagaatgagatagaaaaacatctcctgagagagacatttgaggactccaatctgatactcaaagagattctctggtgaccaaaagaagtcttcagtgatggaataacttcagttaagaattcctggtttaagattttacagaaatatgttgaacatcaggttgatgatgcaatgatggcaaatgcagcccagaaatttcccttcaatactcctaaaaccaaaggatactactaccatcaaatccttgaacaccatttcccaggccaggctgactggctgagccattactgggtgcccaagtggatcgatgccactgacccttctgcccacacactgacccactacaagtcagctgccaaagcttaggtgctctttatgctgtaatatgaaagcaaatatttcttcttattgtatggggactatgggtagataggggaacaatgaaagtcaactcaggctaacttgaatgtgaaaaaaataaaagtcctaaatctaaaacattgctatagtcatttatgttcatacagtctcctcataagaggtaactagaaa

SEQ ID NO: 465957 - DNA, 1437 bp, Homo sapiens
gagtggtctcagggctacggcttgtcggtgcctcgccgcacagtcccctttgcattgaaggacacggtcttacggtgtaggagcatttttgaggtgcattcctggatttggaggcgaacccccaatggttacctccacagaggctttgcgaagggcgctcactgacttaggtgaagagcgaaggctcaagactgtgccgctttatagtggccccttgacgtccagaagttccccccagcgccggtcataagcactcccgccgcctgggccccgccctgcctgccaggcgccctccagcctcagctcccggacgcccggcgtggccgctttctcgcgtcttgctgacccgggccgggggcgtgtgctcctcctgcagcggacggaagatgctgggccacgcaagtttccctgggcttggttaaccaccccgaagcccatttccagaaggaaagggtgttgaggaggagggatagaaagtcgagaagagggccggggtcttgctctgttgctcaggctggagtgaagtagagcattcacagcccactgcaaccttgaacacctgggctcaagcaatcctcctgcctcagcctcctgagtaactgggaccacagatgtgtaccaccatgcccagctacatgtctttcttttggggggacagcagaaacctgggcagaggaggaatcctgatacccagttctgaaacaaagtggcagaatttgtaatacagaagaaggatcttgtgactggtattctgttatccacaagagtaaatgttcccaaataaacaaaactgggatatgaaatggtggagtgtgtggtgcctgttcatgaaaaaaaaaggtctagattgcaagatattccctgatgatatgggaatctgtgatgatatgggaatctgtgatatgggaatccctgatgatatgggaatatggctctgtgtccccacccaaatctcatctcaaattgtgatccccatgtgtccgaggagggaccaaatgagatcttcaaaaccaatagaagatatacaaaccaaacattggtttaaagatgtaacaccaattatacataatctcttccagaaattagaagaggaagaaacatattgtaaatcattctatgagtttgtgacatatgccttaggggatgctgatgcaggcctcatgggcacaggcagcacagagataactattgtcatcatcgtttgccagttgtaagcactctaagcatcacaacagtgcttacagttcacctgaggttccacctgattcacatatttatttgtaatgatatctggaaattaacaattaaaatttttaaatttatatttttaaattagaacaaagtaacatgtatgtcctggttaatataaatcatatattgctgctggacttgtaacaaaatcaacagttccttcaccccatccttcctcacccttga

SEQ ID NO: 465958 - DNA, 3620 bp, Homo sapiens
tcaaagggggtttgttctctggctgacagggctcgcagcctgccagagcgcagctagagtttctgggcagaggagggagaagcaccccgcccatccccgccggcgcctcgcctacgtcactgcttcgagccgcagaccccctccctccttcccggtcgcggtagctttgacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggtctgtgtaagactaccttcctcttagatgccgtcagaaatagaagagcaggttatgaggtgagacaaatggctgccgcactgctacgacggcttttgtcctctgggtttgaggaggtttatccaaatctgcctgctgatgttcagagagatgtcaagattgaactgattctggctgttaagttagaaacacatgctagcatgaggaaaaaactttgtgatatttttgcagtgctggccaggaatttgatagatgaggatggcactaaccactggccggaaggtctgaagtttcttattgattcaatctactccaaaaatgtggttctatgggaagttgcacttcacgttttctggcactttcctgggatttttgggacccaagagcggcatgatttggatatcatcaaacggttgttggaccagtgtattcaagatcaagaacatccagcaatcaggacgttatccgctagagctgcagctgcatttgtacttgctaatgagaataatattgctcttttcaaagactttgcagacttgcttcctggaatcttacaggctgtgaatgactcatgctaccaggatgatgattcagtgctagaatcccttgttgagattgcagataccgtacctaagtacttgggtccttatttagaagatactctacagttgagtttgaagttatgtggagactctaggcttagtaatctgcagcgccagctggccctcgaagttatagtgaccttgtctgaaactgccactccgatgttgaaaaaacatacaaatattattgcacaggcagttcctcatatattagcaatgatggttgatctacaagatgatgaggactgggtaaatgctgatgaaatggaagaagatgattttgacagcaatgcagttgctgcggagagtgcactagacagactggcttgtgggcttggtggaaaagttgttttaccaatgaccaaggagcatatcatgcagatgcttcagagccctgactggaagtatcgacatgctggattaatggccttatctgccattggagaaggatgccatcaacaaatggaatcaattctagatgaaacagttaactccgttttgctttttcttcaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagcagagtccatgccttttctcctggaatgtgcaagaattcgtggcccagagtatcttgcacagatgtggcaattcatatgtgaccccttaatcaaggctattggtactgaaccagatacagatgtgctctcagaaataatgaattcttttgcaaagtccattgaagttatgggagatggttgccttaatgatgaacacttggaagaactgggaggaatactgaaagcaaaacttgaagggcactttaaaaaccaagaattgagacaggtgaaaagacaggaagaaaactatgatcaacaggttgagatgtctctgcaagatgaggatgaatgtgatgtttatattctgaccaaagtatcagatattttgcactcattatttagtacttataaggaaaagattttaccatggtttgaacaactacttccattaattgtaaatctaatttgttcaagtaggccatggccagacagacagtggggattgtgcatatttgatgacatcatagagcactgcagtccaacttcatttaaatatgtagaatattttcggtggccaatgctactaaatatgcgagataacaaccctgaagtcaggcaagctgctgcttatggcctgggtgtcatggcacagtttggtggagatgattatcgttctttatgttcagaagctgttccactgctggtaaaagttattaagtgtgcaaattccaaaaccaaaaaaaatgtcattgctacagagaactgtatctcagcaatagggaagattttgaagtttaagcctaactgtgtaaatgtagatgaagttcttccacactggttatcatggcttccactgcatgaagataaagaggaagctattcagactttgagttttctctgtgacctaattgaaagtaaccacccagttgtaattggtccaaataattccaatcttcccaaaataatcagtataattgcagaaggaaaaattaatgagactattaactatgaggatccttgtgccaaacgcctagctaatgtcgtgcgtcagttgatgtaaagtatataaattgttgctatttgtttgaactattattgatgctagccaagcagtatacttgatgtgaagatgtcatgctatcacaatatgctaagagctcacaaaaataagatagaatttccaggacaaacatctttggaattgtaattctaggttttaacgagggttctgtgtacctagaaaaaataatatgtgcgtctttcaaat

SEQ ID NO: 465959 - DNA, 3119 bp, Homo sapiens
tcaaagggggtttgttctctggctgacagggctcgcagcctgccagagcgcagctagagtttctgggcagaggagggagaagcaccccgcccatccccgccggcgcctcgcctacgtcactgcttcgagccgcagaccccctccctccttcccggtcgcggtagctttgacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggtctgtgtaagactaccttcctcttagatgccgtcagaaatagaagagcaggttatgaggtgagacaaatggctgccgcactgctacgacggcttttgtcctctgggtttgaggaggtttatccaaatctgcctgctgatgttcagagagatgtcaagattgaactgattctggctgttaagttagaaacacatgctagcatgaggaaaaaactttgtgatatttttgcagtgctggccaggaatttgatagatgaggatggcactaaccactggccggaaggtctgaagtttcttattgattcaatctactccaaaaatgtggttctatgggaagttgcacttcacgttttctggcactttcctgggatttttgggacccaagagcggcatgatttggatatcatcaaacggttgttggaccagtgtattcaagatcaagaacatccagcaatcaggacgttatccgctagagctgcagctgcatttgtacttgctaatgagaataatattgctcttttcaaagactttgcagacttgcttcctggaatcttacaggctgtgaatgactcatgctaccaggatgatgattcagtgctagaatcccttgttgagattgcagataccgtacctaagtacttgggtccttatttagaagatactctacagttgagtttgaagttatgtggagactctaggcttagtaatctgcagcgccagctggccctcgaagttatagtgaccttgtctgaaactgccactccgatgttgaaaaaacatacaaatattattgcacaggcagttcctcatatattagcaatgatggttgatctacaagatgatgaggactgggtaaatgctgatgaaatggaagaagatgattttgacagcaatgcagttgctgcggagagtgcactagacagactggcttgtgggcttggtggaaaagttgttttaccaatgaccaaggagcatatcatgcagatgcttcagagccctgactggaagtatcgacatgctggattaatggccttatctgccattggagaaggatgccatcaacaaatggaatcaattctagatgaaacagttaactccgttttgctttttcttcaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagcagagtccatgccttttctcctggaatgtgcaagaattcgtggcccagagtatcttgcacagatgtggcaattcatatgtgaccccttaatcaaggctattggtactgaaccagatacagatgtgctctcagaaataatgaattcttttgcaaagtccattgaagttatgggagatggttgccttaatgatgaacacttggaagaactgggaggaatactgaaagcaaaacttgaagggcactttaaaaaccaagaattgagacaggtgaaaagacaggaagaaaactatgatcaacaggttgagatgtctctgcaagatgaggatgaatgtgatgtttatattctgaccaaagtatcagatattttgcactcattatttagtacttataaggaaaagattttaccatggtttgaacaactacttccattaattgtaaatctaatttgttcaagtaggccatggccagacagacagtggggattgtgcatatttgatgacatcatagagcactgcagtccaacttcatttaaatatgtagaatattttcggtggccaatgctactaaatatgcgagataacaaccctgaagtcaggcaagctgctgcttatggcctgggtgtcatggcacagtttggtggagatgattatcgttctttatgttcagaagctgttccactgctggtaaaagttattaagtgtagaaatgaccaggttttgccagctctaaatgtctgcctcaaaggc

SEQ ID NO: 465960 - DNA, 3496 bp, Homo sapiens
  misc_feature (3495)..(3495): n is a, c, g, or t
tcaaagggggtttgttctctggctgacagggctcgcagcctgccagagcgcagctagagtttctgggcagaggagggagaagcaccccgcccatccccgccggcgcctcgcctacgtcactgcttcgagccgcagaccccctccctccttcccggtcgcggtagctttgacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggtctgtgtaagactaccttcctcttagatgccgtcagaaatagaagagcaggttatgaggtgagacaaatggctgccgcactgctacgacggcttttgtcctctgggtttgaggaggtttatccaaatctgcctgctgatgttcagagagatgtcaagattgaactgattctggctgttaagttagaaacacatgctagcatgaggaaaaaactttgtgatatttttgcagtgctggccaggaatttgatagatgaggatggcactaaccactggccggaaggtctgaagtttcttattgattcaatctactccaaaaatgtggttctatgggaagttgcacttcacgttttctggcactttcctgggatttttgggacccaagagcggcatgatttggatatcatcaaacggttgttggaccagtgtattcaagatcaagaacatccagcaatcaggacgttatccgctagagctgcagctgcatttgtacttgctaatgagaataatattgctcttttcaaagactttgcagacttgcttcctggaatcttacaggctgtgaatgactcatgctaccaggatgatgattcagtgctagaatcccttgttgagattgcagataccgtacctaagtacttgggtccttatttagaagatactctacagttgagtttgaagttatgtggagactctaggcttagtaatctgcagcgccagctggccctcgaagttatagtgaccttgtctgaaactgccactccgatgttgaaaaaacatacaaatattattgcacaggcagttcctcatatattagcaatgatggttgatctacaagatgatgaggactgggtaaatgctgatgaaatggaagaagatgattttgacagcaatgcagttgctgcggagagtgcactagacagactggcttgtgggcttggtggaaaagttgttttaccaatgaccaaggagcatatcatgcagatgcttcagagccctgactggaagtatcgacatgctggattaatggccttatctgccattggagaaggatgccatcaacaaatggaatcaattctagatgaaacagttaactccgttttgctttttcttcaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagcagagtccatgccttttctcctggaatgtgcaagaattcgtggcccagagtatcttgcacagatgtggcaattcatatgtgaccccttaatcaaggctattggtactgaaccagatacagatgtgctctcagaaataatgaattcttttgcaaagtccattgaagttatgggagatggttgccttaatgatgaacacttggaagaactgggaggaatactgaaagcaaaacttgaagggcactttaaaaaccaagaattgagacaggtgaaaagacaggaagaaaactatgatcaacaggttgagatgtctctgcaagatgaggatgaatgtgatgtttatattctgaccaaagtatcagatattttgcactcattatttagtacttataaggaaaagattttaccatggtttgaacaactacttccattaattgtaaatctaatttgttcaagtaggccatggccagacagacagtggggattgtgcatatttgatgacatcatagagcactgcagtccaacttcatttaaatatgtagaatattttcggtggccaatgctactaaatatgcgagataacaaccctgaagtcaggcaagctgctgcttatggcctgggtgtcatggcacagtttggtggagatgattatcgttctttatgttcagaagctgttccactgctggtaaaagttattaagtgtgcaaattccaaaaccaaaaaaaatgtcattgctacagagaactgtatctcagcaatagggaagattttgaagtttaagcctaactgtgtaaatgtagatgaagttcttccacactggttatcatggcttccactgcatgaagataaagaggaagctattcagactttgagttttctctgtgacctaattgaaagtaaccacccagttgtaattggtccaaataattccaatcttcccaaaataatcagtataattgcagaaggaaaaattaatgagactattaactatgaggatccttgtgccaaacgcctagctaatgtcgtgcgtcaggtacagacttctgaagatttatggttggaatgtgtatcacaacttgatgatgaacagcaggaagccttacaggagttgctaaattttgctng

SEQ ID NO: 465961 - DNA, 1130 bp, Homo sapiens
tgggtggagtgtggacaagcggcctttgcatccttcgccgctggttggaaatgcagttttggaccccctcctcccccgccagggctcccacccaaccggaatctgcattttaaccggacacccaggcgattcctgtgcacattaagtaagaatcctgacattctaggatggagagtgaggaggatgagttgagtccatgcactgggtgatcttggaaaggatggagctgtcactccagtgacaccaagcttggagctctgcctgttgtaagaattcccttctctcaagacacacatgtggggcatgtcattgaacaaggctaaagcatcatgaaatacagccaaccatttcttccttgagcaatcaaattgctagtttgggtttgatggtgtgttttgcttttagaagcactgtcatcctttcccacaatgcagagaattgggaggacattaaatctcatggccctcactttcaaaatgtgctcaaaacgctgcctagtagttctcttaatcgccaattggtcctagacaccaaaatctcttacctagattattgccatagcttcataactaaccctatcatcctcaactcttcctgtcccccagtagacactcaacagaaatcttggaacttttgcacaagaagggacttgtgggtgagaggaaaaaatgagcctctgatggaaggaggtaacgagggaaaaagaagtagagagcagaaaggaagcatgagtggacactcagaagttgttttaaccttcccagaagcttccctttataaacagctagacagcttggttcaaaccaatatttggatttttcctgaaactagctaaaataaaaaggaaaggtactcttatatcctaaacacgtggagatttgtgcttagtttaaatgtagtttctccctgtcactgaacatatttggacacatgaatttcaaattgctttctctttcaataatagtgtgatggctggcagtgacaacaaaaaaaattaacatcttaacttaaaacataaattgttttaaagaaagaaatctgaatacataattgtacagataatactcagatgtagccaaaattgtgaggattggcaaatggctaatgattgggaaacaataaaaactgcc

SEQ ID NO: 465962 - DNA, 873 bp, Homo sapiens
agtggaaaaaaaaaaggcaagaatgcctgtttggccaaaagtaatcataagatggttgaaattaaaagtacactgcaggagggcctggatttcagtcagttggagaagggagaagtgcgtgcgcccgtgcccaggcgtccagcagagggcagggcagctgcatctgagcgccgctggagggcagggctggaacaggatgtggctgagccccgagcggggaagagcaggtgctgctcccctgcagaggggaaatctccttccttaccataagcagataggcagtgcctggggctgtgcaattgcagggtttatacttgctagaaaagagaacagaattttacttgtaaagaaaactaaaatgaagctcagcgctttccttacatgcaggaaagatgggtccaggccatggcccttgccccttaagtcgtcctagggtgtcccctccacaccctccagctacgagggactcacaattcctttcccaagctgcccatgcgcatccccagggccctttgctcctcttcctgggcctatgccccagaggctgggcttggcccccatttgtatccttagtccgaggaggactggcccagcggtagcttttgagagtcacaggctgcaatggtgcgggagggagccgcggctagcggaaagcgagaccacccggtccaccaccgcatcctagaggggcactcagaaaggcccagagctggaacgtcatgcctggactccctcactatttggaaagacttctttggagtcctgtcatctaagctacaataaagctttgttcttcattggaaaaatcttgctggaaaatctgaatctagctgtggtgttgtaatataggtgggttgggctgccttcaaaagg

SEQ ID NO: 465963 - DNA, 566 bp, Homo sapiens
tgacctacagatattgacactgtgattgaaaaacttctggattcaggaatggggtgtgtttatttttataatatccagccaaatatcaaaggtctagagaagcttctacaggcatatcttggagatattgtgggtctggggccaacactcagctcccaacctcaggactgtgtgctcatagtgcagtggcagcagcattcttcctcatttgcatatgccagcagcagtgacagcgcagcagggtacatgctcatcagctgtgacagggtaccagtgggttactgggtgcctgcctccgtgcaggtgttcaccacagtggtggagacagcagggttccagagggctaaggtctcctatgggagcaagtcgagcctagggagatgggcttccctggcagtgctctactacagacactcccacaccaagagctctgggctccacttcagctggcatgaggctcctaccacttctctaagcagccagaggcccgtggtgaaagtggcttgctccttgccagttcaactcaccagttcccctggagtctttaagggccaggaatgagtccc

SEQ ID NO: 465964 - DNA, 663 bp, Homo sapiens
tagagctgctgctgtagcttagctagagacccgctgctgttgcatcatggaaaagtgccacatacgtgcacatgtgaaagaatacgcagaccttcatgaaacgcagcaagaggaactcggcgcaacgcagtgttctgacataaatgaggaacgcagctgtgatgaaaaggatgaagaagccccagaggaagtgatgccggcaaagacagcaacaaacttcatattaaaggaactcttattaactagtttgcaggactgtgtccagagttggttccttcggtgggttcgtggtctccctgacttcaagaatgcagctgtggacctttctgaaaatgtgaaactccgaccaagtgcagtggctcatgcctgtaatcccagctcgttgggaggccgaggcaggtggatcacaagtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatatagtattttcctcaacttttatacattt

SEQ ID NO: 465965 - DNA, 372 bp, Homo sapiens
ccttgtttccactcaaaaactacaagtatagttctttgaaaatgtgaaactccgaccaagtgcagtggctcatgcctgtaatcccagctcgttgggaggccgaggcaggtggatcacaagtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatatagtattttcctcaacttttatacattt

SEQ ID NO: 465966 - DNA, 3058 bp, Homo sapiens
ttggctgccttgggtgataactgctccagtttgcaggagtggctgcagactataccacttcacacccgctaggatggccgtaattaaaaaaacaaaaacaaaaacaaaaaatctggcaataacaaatgttggcaaggatgtggagaaattggggtcctcatacattgctgggtcatatggagttggaaaagatgtgacacaattggactctgaacttcctcaaggccagaggaaggcaggacataaaaaacagcacctgatccatagcgtctgcaagacaaaaaccagttacctaagggaagaacagcactctttgtcagtgagtccgtgtctgtccctgaatgccaagatattgctaagttacactttgacctctactgcggagctttcaagcttcgctgttgtgacaagtgctgccactgacatcggctggtttcataacgcctggccccacgagtgcttcatgctagatggctgaattttgatgaccaccatgaggagggtagaaatacagccttgatgagagaatttatgttttcttaacagtgtgacccacatagccaatgttagcaagcactggaagagaacactattaattacagctttaagtggccactaaacatgcagaagatttcctctgaactgagagttgaaggatatggtgcaacaagcccatttcctggcactggaaagcggagagagagctgcaggagaggcggtggtgaaggaagcagtgcagggccatgcgtggcccccgacgtgggcattcggctggagctcttgattctaggtcccagcctgagtacacgaggattcctctggcctgttagctacaacttcctcttctggaggtcttacttgtcatctatgtcttggtcgtctgcatatattttctagaaatttcctcaagcccttctaccgtgaaggtgagccgtgaagtctattgcccagggattggggacgtttgtattaaagaaggttttggagtacagaagcaggaagatgtgttgtggagatgctgttggcagaaacaactggccttgactaaacaaaccaagagttcctacaggagcagaggcaaccgggtgaaggctgacgcccttgcacaggcttgggcagctcttctccacatgtccacgtggctcacttccttacctacttcagggctctgctcacacgtcacctcctcaagaaggccttccccaactaccctgtcctcactcccaccccttacccctgcattccctgtccctctcactctgctgtggtttatcctacctgacatagaacaggtttatctccctgttgtctagcaggcttttatccagttctgctttgccggactgtattaagtaagtctcagttcctgggctttatcactcagcatgggtggaacacacgaaaatgggattttcctgttcccactacagcacttttcttgtggataccacatctccccatgtgcaatattctattcccatctcactcttaccttgtgcagagctattttctcagagcatgagtctctgaacggaaaatctactgctttgtgccctgcctgaggataagcttcaccagagcagtctatattgttgttgctgttgttgttgtttattgctgtattcctagcttctagaacagtgcctggcatggcaatcagtggcatgagtaaatttatgagtatatataatggacaagtttgggagaagataattagtttggaaacgggagagtttagtgggagagacagggccctgactacctcaaaaagcagcagtactataagaggacagagtttctatttttctgcctggtctaggacttgtactggtctttcaacttgaattcatgcagcaagacagtggtggtgaaaagataaaggcatttctacctgggtagacagtttctttttctggagacaagaattgagaaggcctaccagattctggcagtgagttgactgtacttgtttttagcattgtgaatttttgccttcatatgaatttaagtagggagtttagcaatgctgtttcagggtttccatccagattttccgtttcaaattggacatctatttgcacctttaattcgcgtaacaaatacttcacagagaatacaaagttgaattatgggcagctcaattcatccccccaaaggcagacaagagatggcaggtccaagttatgcctatattacacagtagagattattttaagtgttttgttattgcttccaagttcacacaaatgcttcttactaatttatattggtcacattcactattcttatttggtactcattagtgactttgtactctcttaaagaaaataaacctccagattaactaaaacatttaaatatgaattgtacataggctttattcatttataaaatgcaaagaaattaagattaaaaggaaaaccacatcaaaacccagagacataaataaaatgcatttaaatggctctttggtagtttattgatgctgagatagtttttttctccccttgaaaatatataaaattttcttttcatcttccctgaagcatatccaaataagttagtgactacataattaatatccagtttagtgggtatcctttcagttattctcttatgtatataggaataaattttttataacttagattaactgtttaaaacataattttggaataaaggaacaagagaagaaactagaatatggctgctacctgtgtattgttccattaactatgtatatgcatgtggttttttggtcctcccaacagccaatctcatttattcacaagaaagctaaaacagtcataaagatctaggtgataaattttaagccaacaggcaattcaaaaataacaggattgtgaaatatccaactaaaatcatatttgaaaatggtccaggaatccccaaataacttttatgcatgttatatgaagataaatggattttaacgtttctggttttcattttcagaggtcatagacattaaaaaaatttttgataatgaaaggatatttatttccatgttgtgctcaggcctgagctaaagtacatt

SEQ ID NO: 465967 - DNA, 1304 bp, Homo sapiens
gcagccaggcgcacttctctgcccacatcctttaccattttggtgcaccccaggccggctcccaatggccatcccctgcgtctctgtgagagctgcctattgcgctttgtccatgaacatgacaggccagaagtgcgcctgggtgcgcatccaggcgcagttctggtagtttgactgtggtgtgtacatgtgtgtggggattgtctgtatccttcacttctggtagtttgactgtggtgtgtagatgtgtggtgttttgtctgtatccttcacttctggtagtttgactatggtgtgtatatatgtgtgggggtttgtctgtatccttcacttctggtagtttgactgtggtgtgtagacgtgtgtgggggtttgtctgtatcgttcacttgtggtagtttgactgtggtgtgtgtatgtggggggggttttatctgtatccttcacttctggtagtttgactgcggtgtgtatatgtgtggagttttgtctgtatctttctggttgactgtggtgtgtagatgtgtgtggtgttttgtctgtatccttcacttctggtagtttgactgtggtgtgtgtatatgtgtggggttttgtctgtatctttctggtagtttgactgtggtgtgtagatgtgtgtggagttctgtctgtatccttcacttctggtagtttgactgtggtgtatatatgtgtggagttttgtctgtatccttcacttctggtagtttgactgtggtgtgtatatgtgtgtggggttttttctgtatccttcacttctggtagtttgactgtggtgtgtgtatatgtgtggagttttgtctgtatccttctcttcgggtagtttgactgtgttgtgtcgatgtgtgtggggttttgtctgtatccttctcttctggtagtttgactgtggtgcatatatgtgcggggttttgtctgtatccttcacttctggtagtttgactgtgttgtgtagatgtgtgtggggttttgtctgtatccttctcttctggtagtttgactgtggtgtgtagatgtgtggtgttttgtctgtatccttcacttctggtagtttgactgtggtgtgtagatgtgtgtggggttttgtctgtatccttcacttctggtagtttgactgtggtgtgtgtgtatatgtgtggggttttgtctgtatccttcacttctggtagtttgtggtgtgtgtagatgtgtgcagggttttgtctgtatacttcacttctggtagtttactgtggtgtatagatgtgtggggttttgtctgtatccttcacttctggtagttc

SEQ ID NO: 465968 - DNA, 2014 bp, Homo sapiens
  misc_feature (1)..(1): n is a, c, g, or t
  misc_feature (3)..(4): n is a, c, g, or t
  misc_feature (10)..(11): n is a, c, g, or t
ngnntccctnngctgaaactaaaaatgaagagccagcagcccacggtagtggaggagactgtgagagaggatgcctcctccccaggagcatatggcttcctattaactgaagaactgcaggttgcaggggacgtaactccagggagccttcccagaggaggcaatcagagctgggcatggaaggatgaccggcagcaaggaggagacggtgaacagccgacttcaagtcagaggagcgaggaggaagaaaattgtcaggggaacaaggctttccgggggcagatcacgaaggatctgcactgggatcaggcaaacccctgcaaccagcgcgtggagggtctcaaacagaaagctgagaccatggtggtgttacgctgtgtggagcaaaaggtgatcccagggcaggctcatgggccagaggaatatctgagcccgtcttctgagctcttctcagatgcgtccatcaatagctgaatcatttacgatgaaaagtgtgctgtaattctttatttttctgtacataatggtcgataattttctttctttctttttttttttttttaaggttttatctgtatccttcacttctggtagtttgactgtggtgtgtacatgtgtgtggggcttgtctgtatccttcacttctggtagtttgactgtggtgtgtacatgtgtgtgggggtttgtctgtatccttcacttctggtagtttgactgtggtgtgtacatgtgtggggttttatctgtatccttcacttctggtagtttgactgtggtgtgtatgtgtgcggggttttgtctgtatccttcacttctggtagtttgactgtggtgtgtagacgtgtgtggggttttttctgtatccttcacttctggtagtttgactgtggtgtgtacatgtgtgtggggattgtctgtatccttcacttctggtagtttgactgtggtgtgtagatgtgtggtgttttgtctgtatccttcacttctggtagtttgactatggtgtgtatatatgtgtgggggtttgtctgtatccttcacttctggtagtttgactgtggtgtgtagacgtgtgtgggggtttgtctgtatcgttcacttgtggtagtttgactgtggtgtgtgtatgtggggggggttttatctgtatccttcacttctggtagtttgactgcggtgtgtatatgtgtggagttttgtctgtatctttctggttgactgtggtgtgtagatgtgtgtggtgttttgtctgtatccttcacttctggtagtttgactgtggtgtgtgtatatgtgtggggttttgtctgtatctttctggtagtttgactgtggtgtgtagatgtgtgtggagttctgtctgtatccttcacttctggtagtttgactgtggtgtatatatgtgtggagttttgtctgtatccttcacttctggtagtttgactgtggtgtgtatatgtgtgtggggttttttctgtatccttcacttctggtagtttgactgtggtgtgtgtatatgtgtggagttttgtctgtatccttctcttcgggtagtttgactgtgttgtgtcgatgtgtgtggggttttgtctgtatccttctcttctggtagtttgactgtggtgcatatatgtgcggggttttgtctgtatccttcacttctggtagtttgactgtgttgtgtagatgtgtgtggggttttgtctgtatccttctcttctggtagtttgactgtggtgtgtagatgtgtggtgttttgtctgtatccttcacttctggtagtttgactgtggtgtgtagatgtgtgtggggttttgtctgtatccttcacttctggtagtttgactgtggtgtgtgtgtatatgtgtggggttttgtctgtatccttcacttctggtagtttgtggtgtgtgtagatgtgtgcagggttttgtctgtatacttcacttctggtagtttactgtggtgtatagatgtgtggggttttgtctgtatccttcacttctggtagttc

SEQ ID NO: 465969 - DNA, 3654 bp, Homo sapiens
tagaaaccagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggcggggacgggggaagcagcacgggatcccagcctcaggcctgcccggacggtgttggttggggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgtctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacacttcctggagatccgtgtcatgatcgtttctctctccaaacgtgtttctgcttaattgggcagcacatgcctggacaccaccctttgtttcgccgtcgccccgtatgcctccggcgacacacatccacaccatctgctgtggggtaggccagtgccacgcgtggtcacacggtctccacctcggattcgcccctgttcctggtggcacgtgtcctgtaaagcgcggtcggctttccggagcccctgggcttttagaagcggggcaagccactgatatttcaaaggaggtgggaggcagagggctgatggatcagtgaatttgcagctgacgctaggccttgagacctatgggatcattgtgtgctgcagcgaggccctgccggcctctccagatgtggtgagcccatcctatctcagtgggagggggccagaatcggatctcaacgggagtccggagaacacagcaggcgtcctgaagctccccctccctcggtggaagtcggctcaagcagatcctgaggacaggacccctgggggtttgggcctgggacaggacgagacacccgcggccccctctcccacgccgccccaaacaggacccaggatccagccgccgccgcggcggcagcgatatttaaaggggacgcagcctatctgtcaggagcggagcgcgagtcggctcagccaatgcgcatgcgcgaggcgcgagcggtttctcccgtcacagtggttcccacggttgtcttagaaaccagaccccgaggcttggcagagcaggagccctcggtggcagtgcttgggtgtcgaggctctgaggctccggcctcacctctccacggggtcgaagggaacgtctccggatgccaggagtcgcaaagggccgaccatgatgatgaaaccccaggcagagacgggggaagcagcacgggatcccagcctcaggcctgcacggacggtgttggttggggtgagtctccctaaaagtcgtgccgccgtccgtgatctcgaggacgggtcggcctgcgtgcccctgggctgctctctcacccgagggtctctctgtgtgtttctttcccactctctgtgggtttgtgccagccgaagttgcgtcagggctaccaggtcggtggaggattgggggtgttgcgaattttgcagaaacctctttgctcctccggtagacatttgaaaacgtggcttgggtcaggcacaggcggccccccacccccgggtcccaggtgttctttgattttccttggcattgatggaaaggtcacccgtttcccccttccactggcacatgcctggaccccaccctttgtttcgccgtcgccccgtatgcctccggtgtggtgtaaagcgtggtcggctttctggaaccccagggcctttagcagtggggcaggccactgctctttcaaaggaggagggaggcagagggctgatggatcagtgaattttcagctgtctctaggccttgagaattatgagatcattctgtgctgcagcgaggccctgccggcctcaccagtttttgtgagcccatcctatctcactcggagggggccaaaatcggatctcaacgggagtccggagaacacagcaggagtcctgaagctccccctccatccctccatcggtggaagtgggctcaagcaggtcctgaggacaggacccctgggggtttgggcctgggaaaggacgagactcctgcggccccctctcccacgccaccccaaacaggacccaggatccagctgccgccatggcggcagcaggagcatcgcggccgccaggcgacagtggcgatatttaaaggggacgtagcctgactgccaggagctgagcgcgagtcgtcccagccaatgcgcatgcgcgaggctctagtggcttctcccttcacagtggttccttcggttgtcttagaaaccagtccccgaggcttggcaaagcaggagccctccgtggcagtgcttgggtgtcggggctgtgaggctccggcctgacctctccacggggtcgacgtgaacgtctccggattccaggagtcacaaagggccgaccaggatgaggaagccccaggggggtgccctgtgtgccacaaagcggtttttcgcatggcggcctgtctttgttgagcctctttctgctctctgcctgggtcatgaggccggttgtcaatcgtttttgctgctgtggatccgctttggctctgtgaaggcctggcccaccatcaaaacgaacacactgcagacgaggagaagaatcccacaggagctctttgtcctacaggagagcagcggacccacgtcagagaagatgcttgagtcttttcacggctcttctctgagaaatgaagccacaccacgatacagtcagcaagaggaaaccgggaatgagagatggcaacaatccctgtccctagaacgctggcctccctggacaagccacccttttggaaccccaccccttatgcccttggcggtggcacggtgctaaacctctatgctcctctggtaggcatttgaaaacgtagcttgggtccggcacaggccccccctccccacaccccgcgtgtcccacgtgtttttcgattttccttggtattgatggaaaggtgtcctgtaaagcactgtcggctttccggagccccagggcttttagaagcagggcaggccactgctctttctaaggaggagggcattgaaaaacacacccccaagcaatccctgaggctgtgatgttctgctctctacgagaaggaccctcgggtgagagagcagcccaggggcatgcaggctgacctgtcgtagagatcactgacggaggcatgacttttggggagactcaccccaaccaacaccgtccggtcaggcctgaggctgggatcccgtgctgcttcccccgtctccgctgggctttcctcatggtagtcggccttttgcgactcctggcatctggggacattcccgttgaccccaagaagacgttaggccggagcctcagagccccgaaacccaagtactgccac

SEQ ID NO: 465970 - DNA, 304 bp, Homo sapiens
gcaaagctgtgtgcacatgtgttaagtcatctgttctatgtgttctaattataaataagaaaaaacaaatttcaatcaaccatgctggaggaagagcaattatgtttctattccttctatcataggtgatgtaaaattctcaaacaatgagatagataaaaagtacgcagccaaaaagttcaagaagaagtgttacggagatggagcaggcccttcgtaaaaacacgatgttggttttctggattttgtatgtttgttttttttttttcctcatcctaaataaatattcactgtcatacctaat

SEQ ID NO: 465971 - DNA, 2225 bp, Homo sapiens
tagaaaccagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggcggggacgggggaagcagcacgggatcccagcctcaggcctgcccggacggtgttggttggggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgtctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacacttcctggagatccgtgtcatgatcgtttctctctccaaacgtgtttctgcttaattgggcagcacatgcctggacaccaccctttgtttcgccgtcgccccgtatgcctccggcgacacacatccacaccatctgctgtggggtaggccagtgccacgcgtggtcacacggtctccacctcggattcgcccctgttcctggtggcacgtgtcctgtaaagcgcggtcggctttccggagcccctgggcttttagaagcggggcaagccactgatatttcaaaggaggtgggaggcagagggctgatggatcagtgaatttgcagctgacgctaggccttgagacctatgggatcattgtgtgctgcagcgaggccctgccggcctctccagatgtggtgagcccatcctatctcagtgggagggggccagaatcggatctcaacgggagtccggagaacacagcaggcgtcctgaagctccccctccctcggtggaagtcggctcaagcagatcctgaggacaggacccctgggggtttgggcctgggacaggacgagacacccgcggccccctctcccacgccgccccaaacaggacccaggatccagccgccgccgcggcggcagcgatatttaaaggggacgcagcctatctgtcaggagcggagcgcgagtcggctcagccaatgcgcatgcgcgaggcgcgagcggtttctcccgtcacagtggttcccacggttgtcttagaaaccagaccccgaggcttggcagagcaggagccctcggtggcagtgcttgggtgtcgaggctctgaggctccggcctcacctctccacggggtcgaagggaacgtctccggatgccaggagtcgcaaagggccgaccatgatgatgaaaccccaggcagagacgggggaagcagcacgggatcccagcctcaggcctgcacggacggtgttggttgggagacgaggtctcactatattgaccaggctggtcttgaactcctggccttaagcgatcctcctgccttggcctcccaaagtgctggagttacagatgtgagcctctgtgctcagtccatccttggctgttcaagtgtagagccaagaatgttaaggaacgtggacacaaaggatgaggttggaacagaagtttaatatgcaaaagaagaaagctctccccagcggagaggggacccgaaagagggttgccaactaggaggctgaatctgggggttttgtgaactgggaaggggaagaatgtgctcactagtctgtgagctgtcttggagaaagcacaacttcgcttggcccgggaccttagcttgggaccaaccagaggctgaagtgaaattttggcccaagaacaatcaggggctgaagtgaaagtttggcccaggaccaatcaggggctgaagtgatgattcatagaggcttggctcacagtccaaagcatgtccagaaaaggaaagtggtcaccagagcctgttagtccaagctgcaccgatttgtaagcccccaccgtttcacagaccctggtcagagggaaacattccactggggtttgggctgcgagaaacatcctccccaaccgcctga

SEQ ID NO: 465972 - DNA, 541 bp, Homo sapiens
tagaaaccagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggcggggacgggggaagcagcacgggatcccagcctcaggcctgcccggacggtgttggttgggagacgaggtctcactatattgaccaggctggtcttgaactcctggccttaagcgatcctcctgccttggcctcccaaagtgctggagttacagatgtgagcctctgtgctcagtccatccttggctgttcaagtgtagaggtgatgtaaaattctcaaacaatgagatagataaaaagtacgcagccaaaaagttcaagaagaagtgttacggagatggagcaggcccttcgtaaaaacacgatgttggttttctggattttgtatgtttgttttttttttttcctcatcctaaataaatattcactgtcatacctaat

SEQ ID NO: 465973 - DNA, 844 bp, Homo sapiens
gccggctgtcaatcgttttcgccgcggcggatccgctttgggtgcctgaaagcctggcccacgtgaggagatgcgtcgctcccggagcaactgaaatctcatccccatcctgagtggcctcttttctaggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgtctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacacttcctggagatccgtgtcatgatcgtttctctctccaaacgtgtttctgcttaattgggcaggtatcatgagccgagagctcttggcttccatacgtgtctcaggcagggaagcttccttcttccccacgtttcccctcatgggtgggtggattgcctagaatgagcgctaggcgaccgtgactggccttgacttccaggacaggtggtgtcccatttcctttgcacttcctgtctcattcttgagggacatcctctcctctgctcctgggtggcctgactcccttgatcttctggacgaaacaaatgtcagg

SEQ ID NO: 465974 - DNA, 4235 bp, Homo sapiens
agctcagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgccggagaggcctggaggagacttcggacctgctttcacaactgcagagcctcctggggccacaccttgacaaaggtgactttggtcagctctccggtccagaccccccaggtgaggtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcatttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggatgaatcaccagggacaagtcaggccaagggcaaacccagtccctggcagtcctccatgtccacaggtgaaggcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgtgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcatccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaacccaaactgtcaaggctcatgcaagagccaaaggccaatgtttccccctattcacaagagtgagaagtctaggaaacccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcacgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatattccacaatatatatggttttttattcataaaaaa

SEQ ID NO: 465975 - DNA, 4056 bp, Homo sapiens
atgcgggaatgaagccatggtgggccagggactgggcgttacccagcagggggcagtgtgtgtgtcctggggagaccaatgcctgcctggatgcggagggggctggtagagagtgccggagaggcctggaggagacttcggacctgctttcacaactgcagagcctcctggggccacaccttgacaaaggtgactttggtcagctctccggtccagaccccccaggtgaggtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcatttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggatgaatcaccagggacaagtcaggccaagggcaaacccagtccctggcagtcctccatgtccacaggtgaaggcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgtgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcatccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaacccaaactgtcaaggctcatgcaagagccaaaggccaatgtttccccctattcacaagagtgagaagtctaggaaacccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcacgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatattccacaatatatatggttttttattcataaaaaa

SEQ ID NO: 465976 - DNA, 2150 bp, Homo sapiens
tctgtagatctgggctccctgaaaaactgcagctcttctctccttctcatccacaacatggtgagtgggttgggggagtgtgtttcagctgtgtttgtgttacacctctttcagttctgccattcagtgggtcccaagttcttgtaccacatccaggaagaattagcagccatggatggacccagaagaagcaccacaagttctcactgtgggccatggatttcacttggaactggtagcctggcctccaggcttcaggctatcccaggcttgaaagtggggcttcattggggacccactcctttccactcaggaacttgtctgcctcctctcctgatgccatcaacatgctttccatggcacccaggctgtttgtccaaagaaatgccagcaggctggcaccaagacaccctcagcccccttcagcctccctcccatgctcttcagcacccaaattccagagggagtcaaggcggcagggggctggtgtgtcaatgcttccctaagcatggcacacttggctggtttgtgacagggtctgtgcttcacctcaactttgctccagaatcagagctggtgctgggagcagggagaggccaggctgtggaagaaggcacgtctgagcccgtgggggcagtggagcttcctggaactccaagagcacagagatgcctgagtccagagccatggctgggcagctgcagctgagcccatgagtgcagggctcccaccctgccaatttggcaaaggatcctctccttgtggtcactaccacccctggtccacagggggctctttcaggacaccactgatgtttacttaaagcccaagggctcttctgtcagcctgtggtgaatgttgctaggcctgcgactcacccttcagggcagagtgttcccctctggcccatgacaggtctaaaaatgctgtgcaggagcctaggcctggacttggaagccccaagagcttgctgggtgctctatccctgtggcttggcagcattgccaccaaattatggtagtggacattctaagtaaaatgcttaactattattttaatttatttaaaataaagtaagcatcttggtttttctgaaataacagcataaggaggaaggtttagtcattaaacttatcactggtttgctttgctacttttgtcttctttgtggcataatataggctctcattctgtgctgagtactaggatgatgtccatggcaccaaaaaaaaaaaaaaaaaaaaaagaaaagaaagaaagaaataagagcttttctttcttttatttgtaatttttttttccgtcccaaataagaaaatcattagaggagcatagtagggaggtgtctccacttcctattaagaatcacatattctataagcagacgatattgaagaaacaagctctgtatttttagaatattattttatttggggcccataaaagtttagttgttgataaggttctaaatattctaggatgattcacacaattattataagattgtagtttttctactttgtgacctatttactaattgtaaagggttgacatttcaaaattttatagattcatttcaattcttttttgcatctgaactaagcagcttcttcaataaatcataaataatgggaagtaaggtgcttaaaaataccaataatgagataattatgtataaaatggaaagtgtaatgggaattttgtctaaataaaaaatataaatcccattacttgttgcatttaagaatatgaaaagatacattatgaagaaaaatataatttaagtgtgcatctaagcagcattatttcttcatatgtagtcaagtaggaaaattaagaaaaagctgattagatccttaagaattaatcagtaatttctgagaatgagaaagaagaatcagtgaacagtagcacaactgaatgattatgtacaagattctttataagctaaagggtagctatttctttaaataagacttacaaagtgggagagcagaataaaaaagtgtatggaaacagaaaataaacagattctgacaagagaattattcaaaacggacaaattacaaaagtagcaaacatgcactcaggctgtggatttgcctttggaatttcacttaatacagtattgccagtcagtcattcttgca

SEQ ID NO: 465977 - DNA, 1301 bp, Homo sapiens
gcagcaacgtctgatgctcaagccatgagccatacatcgcgggtgggagatctttttcttttgggtccaagttttctttggaggcttcagtctgttgaatgctgtgaatgtgcatcttatatctgggcccagagggctccaggaaggaaggaaagttcctctccaggtgaggaaggtgctgatctcttcactccctttgtctccgttgagaaaaagttctcctggttgtcaaagaggcaggactggcatcagttccatgagctacgaaagcaatttgtggagaagtcgtcctgtgcccagcccctgggtgagctgaccagcctggatgctcatggggagtttggtggaggcagtggcagcagcccgtcctcctcctctctgtgcactgagccactgatccccaccacccccatcatccccagtgaggaaatggccaaaattgcctgcagcctggagaccaaggagctttgggacaaattccatgagctgggcaccgagatgatcatcaccaagtcgggcaggaggatgtttccaaccatccgggtgtccttttcgggggtggatcctgaggccaagtacatagtcctgatggacatcgtccctgtggacaacaagaggtaccgctacgcctaccaccggtcctcctggctggtggctggcaaggccgacccgccgttgccagccaggctctatgtgcatccagattctccttttaccggtgagcaactactcaaacagatggtgtcttttgaaaaggtgaaactcaccaacaatgaactggatcaacatggccatataattttgaactcaatgcataagtaccagccaagggtgcacatcattaagaagaaagaccacacagcctcattgctcaacctgaagtctgaagaatttagaactttcatctttccagaaacagtttttacggcagtcactgcctaccagaatcaactgataacgaagctgaaaatagatagcaatccttttgccaaaggattccgggattcctccaggctcactgacattgagaggcattttatgcatactgccaagtttccttcaggaaaggttgttcacagcagttaccattcctttacatctttgtccgacatgatcgttgtcttttcatctttgccagtttcatttttactctgaattttgggagaacatcttatatcttctaatttgctgattctgttttctgcagcatctaatattctggcttctgtctttactgagttcctttaaaatgtgagaatttctgttgtgttattttcttccctttaccctcatcactcatt

SEQ ID NO: 465978 - DNA, 3886 bp, Homo sapiens
ggagagcagcgccgtctgtactgggtcctgcagcctctgtcctttcaatgcctggttttttctgtgactgctggccttccctggagatcagagcgctcctgtatgccatgggctgtattcagagcatcggaggcaaagccagagtcttccgggaagggatcacggtgattgatgtgaaagcctccatcgaccccgtccccactagcatcgatgagtcctccagcgtggtgctccgctaccggacaccccacttccgggcctcggcccaggtggtcatgccgcccatccccaagaaggagacttgggtagttggctggatccaggcgtgcagccacatggagttctacaaccagtacggcgagcagggcatgaccagccctggccaagggattgctgcagccctcatccaccttccaagcactggaaacaaacattggagaccaaggtctccagaagcttccactgactgctgttggctgcaccaggcaacagggtctggctctgtcacccaggctggagtgcaatggtatgatctcggctcactgcaacctctgcctcccaggttcaagcgattctcctgcctcagcctcccgagtagctgggattacaggtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaatatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttcttcccggttgtcttgggagaagggtgaggatgggcatttagacccgaaaccagctgctcactctttctttttggcagaaataaaaccacaggtagattctgcctgaacagccccttctctccctccacccccaggtcgtatccctgcacctgcggagaggggctgtgagctctggcggggggtggctccaccagtcgcctggcctcttctcccctctcttcccagcagccttaacttcccttgggcggctctaggaggagagaggcaggctcctgtgagcccagggaattttcaccctctcagtcctcaggacccacccccagttgagtccctggcccttcctccaggtgtgtggctttttccttctccatccacactggtcccaaatgcctgggggccggccacctggaccgccgacacacagcctcaatgttagtctcaaaggtaaggaaggcattcacgtcccttcttgcagggcattttaagacttgaatcgggtgggccccggcccctgtggctggctggcccctggtgtactgtaaaagggccaagacagggctcgttctcaggggcgcccctcccaggccctcagggcagcgggacggtgcagtcaggctctgggtgccacagtgatggaggtggaaggcacccaagctctagggaagtcttgggaggcagtcggccgagcccctgcttcctgtcctcaaataagtgaatccaggccaagggctgggagggctgggtgggcttatcgtcgagagggttcagagccactctggaggctgggctggcacagtggagagcaacaggtgaggacagacgtctggaagcccatccctgggacctgccctccctcggtcccaggtcactggagctccagggcttacttagtcctgacccattgtgccagggttctgagcagtgtcggccttgtggccacttgcaggggctattaggggacatcccgctgaagccacgctccttccagcttgccaaacccacagctacccgcccgggacccacactcagcctaataattatcaagcacagaaaaccgtccatttagaaaaataatccatttctgctgcagatgagccacttgtaagagtctccgtgacagcgtgggacggtgtgggaaccaaagtccctgccctgctcctttgtccacgggctattgcgtttattcaaggggtgcttaatgaccgtttagccactgccgtcggtctccgggcccagctcgtgccaggaggctgtcctgggacacactgggctggagctgccggctggcacggtgctcagggggcccctgatgggggccaggacctccccgcagaaactgcaggttctcttgtgaggatggaggccgtgccaccccgaaaggcagtagccttaggggaacagtgggtcccagctgcatgtctgaggatgggtggggacagggctgggactcagctttcattcactggagacttctccactcaggtctttgttgcactaaagcagggacaggaccctgggggttcaggaagcgggtctcaggccgctggtttattcctggaggtggggctggagaccagaatggaaaggggcttcctgagctgctagggggtgaaggacccccgaacccgcatttcttgagtgagagcaaacactcgaggcaggagccagcacccctcccactgcatgcccggcccccagcccaccttgccccctgacccaccttcacccgtgccccttctttctgcccttcctcaccgaagaagggctaggaacaccctggagaggctgcaggtccggccacggacgctcagctgagccccggtcttgctccttcagcctccttgctcatgttggagcacaggccccaggcttcctgccagggccccgattcttcttatgtcctccagccccgccctggggtggacatccactcactccttccagcaataagaaccgtccttggtcgtggagagtactgtgaaacaaaccaatgcacttaccaggaggcacaagactcttgaagaagatgtacaatgaacctttttttttttacaaaaaacaaaaagcaaatattcataaagagaaataaaatgtaattttaaagtagg

SEQ ID NO: 465979 - DNA, 1059 bp, Homo sapiens
ccgggagcatggtagaaggagccacatggggacaaagagagctctttaaagccctcatcttctgggtgccctgccaggccctggtggggcctccagtcgcagaagcgctgcagggactggcgagactccaccacgtcgcggaagccaacagcacgtcggcccaggaacgcccctccaccccggccggccgcctcccaccccacctcctgggtgcccgtcagcaccgcggcccacggagcgcgcgagcccaggggcccaaccgagcgcagccaccggacgccccgcgtggccaccgcgtgggcctctcccgcgcctgcgcagcccgcccccttcccggcagcaccggcggcgtcaaggcaggcacgtggcggcggctgcgcatgcgcgggctcgggccttcccggcgtctccgcgcaggcctcggggaagcggggtccgggggagccgtggtgcggtgggaccgcgtgggtcctggaagagctgcagaggaggtggggacactcagttgcagataggtgatgggagacagtcggggcccaatttgaagcagttgccagtggatgataaagttgctctcaagagcagtgcttgagggaagaaaataaattctccgtttcaaaagaaaatccagggcgggacaatcttactgttggaacaaagaaaagagcccgatggaaaaacggttagcttttgcttttgagaaatgtggtacctccgtggcttgatggcaggctgcatgcatccattcgcggcgagtagaatctaagactgcagcccgtgctgatgactgtggctgtgatgaattcgtgcctgtgaccacagctgctctccaggtgctgggtggctcctcccttgacgcccatccattctgtctcctgcctggccttgttcactgtcgctcatctcgctcagctgaggtccctcctcctccgctgtttggtgtccttgccagttaatcacccttaggtgctgggccctggacttacggacaacatggagcctggcttgttgacaggacagtgtctgcgcctctccgtctacacccccacaacaggggtt

SEQ ID NO: 465980 - DNA, 1404 bp, Homo sapiens
gaggacagcagaaatgatagcgatagctagtgcccagtgcttgcttcctgcatggcaggcaccttctaagcactttacacatgttgatcgatttatttatcctccagtgctagtattatccccatttcatagatgaatacactgaggggtgaagtcacgtagatagcacttgtggttacggcgtaaccctcccctccacgctgactagagcattggcctggcgtaggcaaatggctgagctcttctggatgaactcagggcatctctgaggactgtggacctggcccagccctccgcagggtgtaaccctgctctggggtgaactttcattcactgtggagcagaaaatgcatctatgagcatcaatttactgtgtcctgcctggcttcagggcctcagatgcatcctgaagagcatccagggaagtcttagagccatgggcttctctgctaagaactggtgatgtcacgcaggctggaagctgacaatttaagtcaattcactctccaaaatgttgcacccctgctgcgtgttaagctcattaaagttggagagttgaatgagctaatgttcatgactcgctccctgctgccctcagccccctcatcctgtctggcccaggccggcaacaggcccccatgtggcttccctgtgcccctggccttccactacggagtccccacgcagctgcccggaggatcttttgaaacttgtcaggcgcggctctgggcggtctttgatgccttcctgtccttttccccaaatcgcatctgtgcgtatgagcagaggggagttagtgcacacccaggccctgaggtggcacctggtttgcagcaagtgctcactgcatctttgtggagagcttagctttggtgaacgccccctgaggcccatgcccccgcggactctctgcaggctgggtggggcacagccatagcaggtgtctcctggggggccggcacagctcggagccccaaggccgccaaagagctaactagctcaggggatcccatttcccttggctgagggacccacagcccgcgcatcccaggaccagctccctggacggggtctgctatgttggagaaggctccaggagcccctggatcattctgagctaggtccagtgtactatttttctgggatctttgggaagcaacttctattccacaaggatctcccagttcagctgcccccaaaccaacgcccccagagcagttttcggttcatttggatcccactgaagatgccacgtgacagttagttgtgtctctggagtcccctctgagacagtcactcaggctgtctttgtttttcatggccgtggcagttttgaagagtagtggtcagacaaacctgtagaatgttcctcagcttgggtttatctgatgtttcctcatgatt

SEQ ID NO: 465981 - DNA, 1218 bp, Homo sapiens
  misc_feature (1203)..(1203): n is a, c, g, or t
  misc_feature (1211)..(1211): n is a, c, g, or t
  misc_feature (1213)..(1213): n is a, c, g, or t
agtaagatatggttatcaaggcctggagaggcaaaccatgtccagaaaaggtccctgatgatagaactccctgagtattcttgcagaaatgaatatccaccaggcttcttcttttttttttttttttgagatggagtctgtctctgtcgcccaggctggcgtgcaatggtgggatcttggctcaatgcaagctccgcctcccaggttcacgctattctcctgcctcagcctcccaactactcaggaggctgaagcaggaggattgcttgaacccaggaggcggcggttgcagtgagccaaggtggcgccaccactctccagcctggcaacagagcgtgactccgtctcaaaaaaagaaaaaaaaaaatttcagggatatttatgtagtgacctgttatttaatttttcaataatataaatctgtttcaagaaaaagaaattttaaataaactcttatgattttctttctcctgaaaattattccagaacttaaaaaaaaagaagaaacaaaacagatgttgcctgtggcgcttctcctggcctgagccatgggctccacgtccagctcctccacatcccagaactcgcgtcttggtttcctgagggaacccagcagcagccaggcatggcccatcctcagtggtcagggtcccagctctgtgccacactctcctgagctcccggaggaccggggctgctctctgctccaggtcccagctcctcctgctgatcctggctccgctgtcaccgctgggcccaccttggaggctgcttcagttatccgggccccagagaggacctggccccaggagaagccacaggctggggactgtgcccactgccccctgcaccccagtgccggccagtcccacatgttgggggcagggccatttccattgtcatctagatcagtggcactgcctggcactggcctctccaccattgaaatgaggcccccggaagtgggcctcttgcacgcctggcccagagaggaggaaagctgtgctgaaagcagagggagacagcagggatggctcctgtcctgcccataccctgcccattctggacaggtcacttccagctcccttgtatgttcaaatcctgcctgcctgcatcttcccttgctggtctctggaacaagcaaggatgtcaggagccaggggagatttgctgtgtgaccccagctcagctgctgggcccttntaagtgcnanctttc

SEQ ID NO: 465982 - DNA, 1495 bp, Homo sapiens
ttcaagctgcaggcgggaagcgctctagcaggggctcgccttgcgagagtccctgattcgagcctcttttcttcctcttcaatcaatactactctctcctactcaccattcaaaccgtctatgagcctaaattttcacggccatgggacggacaaggaccccgtctttagccgaactaaggaaaaggtggaaaattcccctggaggggctcgggccatgagaaacatcctggcaggtcccaggcctaaccgtctgactgcaggaaattcttcctttatcacatcctgccctgcagcgacccatactgccccacctctcctgtcgggacctacaactgctccagtctgtaagcggggcttgggctccagcgctgtctggccccagccatctccagttgtgtattcattcacaacccatgagctggcaccgggggattggcagacccttgttcctggaacttctcactggttatcacgcctaatgttggaacactgtggtacagtgaactctgattcctggaattgttaccaggcgaccacggcgtcatcaaatgacctggcaattccgtctactgatgtctcgaacatgtttcagactaagctacgaaatgaaacttgggaagacttgccaaaaatgtcctgcacaactgagatccaagcagcattcattctctcttcctttgtgaccttcttcagtggactcatcatcctgttgatcttcaggctgatctggagatctgttaaaaaatggcaaatcatcaagggaacaggaattatcttggaactgttcacatcaggtaccatcgctaggagccatgtaagaagcctccacttccagggacaatttcgtgatcatatagaaatgttgctttcagcccaaacctttgtggggcaagtgttggtgatccttgtctttgtactaagcattgggtctcttataatctatttcatcaattctgctgaccctgttggaagctgttcatcatatgaagacaaaaccattcctattgatttggttttcaatgctttctttagtttctattttggattgaggtttatggcagctgatgacaaaatcaagttctggctggagatgaattcaatcgtaaacatctttaccatcccaccaacctttatttcttattatttgaaaagcaattggctaggtttaaggttcctaagagccttgcgcctgctagaactccctcaaatcttgcaaattttacgagccatcaagaccaggtaaatagccctgaccgaagtactgcttacttattagtttggattagaaaatgaatgtattaactggaccctaaactcaatgcatttcttatcagaatttcagtgcaaagatcatgaaatctttcagctgccaaaatattatttgttcacattctcccattatattacatcttacactagctgaaaactttgcaatcattttaaagaagctggtttagtctttgttttttaagctatggtgtataagtttattt

SEQ ID NO: 465983 - DNA, 1452 bp, Homo sapiens
ataaggaggagagcttgtgggcatggctgagctacctcggagacgtcctctgacccggtctggcctgacctcgcttttcttcattccaattggaccatttgtgtattcactttcgtttttatcctttgcggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccattgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaagtaagagctcaggcttccctagggcctcttaaatatcatttctcagtaatgcaaatatgcacatcacagcattagtggagaaaagttcctccctttggtattcaagtgaagggaaataaatgtgctttctagtatatccccctcaattctaagaaaagatataaattacatgaaaagagaagcagtcactacgatatcgaaggaaaattgtgtgtgttttgtcagatgtcaaaacactttttacgcccctcacctgtgtgttttgtccataaaactagaacaatattcatcaagttcagatacttccctaaatgtttaaaaggtaagatgataaccttaatttccagtcctaattttaggagcagatacagggttattggttatggtactttttaaaataaagattaaattaaatgtcttatgagactaaaactctgatctctgaatattgaaatttccattatatgaagtaatttttgcccaaaatataatttcataacacagttccccgaactgattgaatgaatctagattcagtcagtcttctatggttaataaaatctatagtgaacccaaagaaatgctggtctgcataaagtcacattaatgcaggctgcctattgttaataaaagtactttcaagatattaaatcattagtaatgttttaagatttttgtattatgtcaaaccaaatgggtaaatacataaaggaaaatcaaaaatgtgcatattttctaaaacaaaagaatccttcccagctaagactttattgaataattccattgagatgcaactctcatcaagaactcaccaagggag

SEQ ID NO: 465984 - DNA, 1521 bp, Homo sapiens
  misc_feature (1497)..(1499): n is a, c, g, or t
  misc_feature (1503)..(1503): n is a, c, g, or t
  misc_feature (1506)..(1506): n is a, c, g, or t
ctggctaatggggagtggtcttgtggagacccatcacaggcagcgaccagccagggtcctgtggtcctgggaagcagcacctgcactgttccctgggaggaagccggtagccttcgtggggtcgctgactgcatccccagagtgcagagagctcaatgaagacagcactcgagtcagaaatcaatgtttactgcagagaacacagaagccagcaagcagtaggcaagggaggcgtcgcagtgagtgtgtcgggcaggctgggaaccagcgcaacggcccacgtggaccgaggactcacgcagagcaagtcacagaaagcgcagctgaaaacaaacggatgcttatcccagatgcacaggacacttaccaaggactgatgggcagctgagtggggctgggaggatggtgcccgctggtcagggcagccctctgggtcagggtgactgagcaaggctggaaggatggtgcctgctggtcagggtggccgcgtgaggctgggagggtggtgcccgctggtcctgaggaacctttgtcccaagtccatccaggtaagtcaggccgcctctctgggaggaaggctgggccaagagggcacgtggtgtggcccagttccggggacgggggtctgagctcagggactggcactccagcaggaggagagaagccagaggaccaagcacagttggggcacagaggccgggcagggacaagcggccccgggcactgaagctggctgggcagggatgagtggtcccagggctcgctgcagagctcggggacccagagggcagagagtccagactggggccttcagcggcagatgaaaggcttaagcagagtggacatcacaggcaggcagcagcgggaagtgctgggctgcccactacaccaggagcctctcctgctgggtgctctgaggtgacccaaacacgtccaatggatggcagtgaatactccctggtctctggtgctgagccccgttcgccatcgggaacttggaaaatgctctgtggctgcaaggagcctctggtggcttctccatcactgcggtgtcttgatcagagagactctctgcagtggaaaggtctctccctcgctggcacgttcccacatctgactgggctgcttttccgggggtccccagggcacggaacacagtgcgcacggccctgcgcccccatcagacgcgggacacgagggagccacggagcaggtgtccggcgaggctcgcaccgcagggcccgagtccgcagatggccccggctcagggcttcttccgagggtggcgtttctgatggcggatgagacaggagctgtaggcaaaggctttcccacagtgcgtgcattcgtagggcttctccccggtgtgcgtcttctgatgtttcaggagattggagccgcagttaaaggctttcccgcactccccgcatttgaagggcttctctcccgtgtgagtcctctggtgtttggtgacgtcagagctgtgccggaaggccnnncgcntgngcacacttgaagggc

SEQ ID NO: 465985 - DNA, 1167 bp, Homo sapiens
  misc_feature (1143)..(1145): n is a, c, g, or t
  misc_feature (1149)..(1149): n is a, c, g, or t
  misc_feature (1152)..(1152): n is a, c, g, or t
atctgctctaccagcctgaatgctgggcagctgagtggggctgggaggatggtgcccgctggtcagggcagccctctgggtcagggtgactgagcaaggctggaaggatggtgcctgctggtcagggtggccgcgtgaggctgggagggtggtgcccgctggtcctgaggaacctttgtcccaagtccatccaggtaagtcaggccgcctctctgggaggaaggctgggccaagagggcacgtggtgtggcccagttccggggacgggggtctgagctcagggactggcactccagcaggaggagagaagccagaggaccaagcacagttggggcacagaggccgggcagggacaagcggccccgggcactgaagctggctgggcagggatgagtggtcccagggctcgctgcagagctcggggacccagagggcagagagtccagactggggccttcagcggcagatgaaaggcttaagcagagtggacatcacaggcaggcagcagcgggaagtgctgggctgcccactacaccaggagcctctcctgctgggtgctctgaggtgacccaaacacgtccaatggatggcagtgaatactccctggtctctggtgctgagccccgttcgccatcgggaacttggaaaatgctctgtggctgcaaggagcctctggtggcttctccatcactgcggtgtcttgatcagagagactctctgcagtggaaaggtctctccctcgctggcacgttcccacatctgactgggctgcttttccgggggtccccagggcacggaacacagtgcgcacggccctgcgcccccatcagacgcgggacacgagggagccacggagcaggtgtccggcgaggctcgcaccgcagggcccgagtccgcagatggccccggctcagggcttcttccgagggtggcgtttctgatggcggatgagacaggagctgtaggcaaaggctttcccacagtgcgtgcattcgtagggcttctccccggtgtgcgtcttctgatgtttcaggagattggagccgcagttaaaggctttcccgcactccccgcatttgaagggcttctctcccgtgtgagtcctctggtgtttggtgacgtcagagctgtgccggaaggccnnncgcntgngcacacttgaagggc

SEQ ID NO: 465986 - DNA, 934 bp, Homo sapiens
atctgctctaccagcctgaatgctgggcagctgagtggggctgggaggatggtgcccgctggtcagggcagccctctgggtcagggtgactgagcaaggctggaaggatggtgcctgctggtcagggtggccgcgtgaggctgggagggtggtgcccgctggtccgggtggccaagagaggctggaaggatggtgtctgctggtcagggcggcccaggaggtgctgtccaggcggagcccggggctggtgtgggtgcgccatgctcctgagaagtttctgggttgtggctttaatgttctcctgcaataagaacgctgacacttggctgaaaggtcctcacgtctcccccagtacacttctgagatgccaggaaggcattctgaacatcaggctgattcctgggactcccctccagggtgacctcaccggagtcaggagcccccgccccgcgcccactgccccactaggatggctctgcagtggcctgaggacagtgaacactggggtgtaaagttgcccactgtgatggttttgacctttgaagaaatttgggaaccaagtgaaagcccggcagctatttctaggcatttcagagggtgcttccctgcacgatttcagagggtgcttccctgcacgatttcagaaggtgcttccctgcacgacttcacagggtgcttccctgcacgatttcagagggtgcttccctgcacgatttcagagggtgcttccctgcacgacttcacagggtgcttccctgcacgatttcacagggtgcttccctgcacgatttcacagggtgcttccctgcacgatttcagaggctgcttccctgcacgcactctgccgcacaccgcactccctgggccaggagcctgctgcacagaaggaggttccttttcttctctttccagcgcttttcttctccttttcttc

SEQ ID NO: 465987 - DNA, 3845 bp, Homo sapiens
ccaggagaggtgactgagggacagagagcaggagagcccaacagcctggacgcagaagaggccaacagtccggacgtgacagcaggctgtgacccggcaggggtccacccaccccagtgagcaggcccaaggcagcgagggcccacacccctcacatgcaaaactggcctcttctggtcactggtgtctgaaaccaaatccagaacagcctgtggcctgtaaagcatatatttctaacgactgcagactggtgggatgataggagccttctgaatgaccaggactgctttcttgtggagctgatgaaaacgtattcttttagcatgttagaaatcactcttgcacacttgcccccactgcccctttcctggcatggggtgagatcggtctacttcagcaaccagtgcctgcccttgatccctgcaggagctgaaggagatgaccactccagggtcaggctgacccagctggagggagagcctcattctgactacatcaatgccaacttggtcccaggctacacccgcccacaggagttcattgcctctcaggggcctctcaagaaaacactggagaacttctggcggctggtgcgggagcagcaggtccgcatcatcatcatgccgaccatcagcatggagaacgggagggtgctgtgtgagcattactggctgaccgactctaccccggacacccatggtcacatcaccatccacctcctagctgaggagcctgaggatgagtggaccaagcgggaattccagctgcagcacctcctcaggggctgtccctgcggtgtgggcatgggccggacaggcaccttcgtggccctgtcgaggctgctgcagcagctggaggaggagcagatggtagacgtgttccatgctgtgtatgcactccggatgcaccagcccctcatgatccagaccctgagccagtacgtcttcctgcacagctgcctactgaacaagattctggaaggacccttcaacatctctgagtcttggcccatctctgtgacggacctcccgcaggcgtgtgccaagagggcagccagtgccaatgctggcttcttgaaggagtacgaggccatcaaggacgaggctggcttttccgcacccccgcctggctatgagcaggacagccccgtctcctcaccaatgctgatcatgtctttgccacagggggagagcaggaaggaaagggaggtgcagagactgcaatttccatacctggagcctgggcatgagctgcccgccaccaccctgctgcccttcctggctgctgtgggccagtgctgctctcggggcaacaacaagaagccgggcacactgctcagccactccaacaagggtgcaacccagctgggcaccttcctggccatggagcagctgctgcagcaggcagggtctgagtgcaccgtggatatctttaacgtggccctgcagcagtctcaggcctgtggccttatgaccccaacactgattggggcaggcggggcgagcctcctaaccctatgtccatctccagaagcagtatgtctacctctacaactgtctgaacagcgcgctggcagacgggctgccctgagtcagcactggtcacggtgcaggagagtagagcccccggggcggtccccaccgacggcgcagcccgccgggaccgggagaaagcagctgcggacaccgcgcccgtgcgtctgcgcgcctggccgccaggtgacccagcagcccggccgccgagatgcccaacccgcccaggctccgggcgctgtgacttcgcgccgctgtgtgcgcctccccgagcgccggctgcgccccccagcccggcccggggcctaccgcctgcccggccccctgccactgccaggaggacggcatcatgctgtctgccgactgctcttgagcttgggctgtccgccataccgggggacctggatcccctgacggcttacctattccatgtcagtagtggcaaacctttacaggattatgaatacaaaatgccactggtctcctgaagatacagcagcaaaatgaaacatccacaaatatgacttaaattgagaatatgtgcatgtctataactccacccttcactgtgctgcggttgttctctggaccactcctatttcatcagtgttattgtcaacctgaagaacaagcagaaagaggctctctgaaatgaaatggatgcttatttgggaagagagcattgcaacgggaatacacatgccatcgtaaatgacaagaatattcagggaggaccccatcacatttggctgccatatctccttggactcctcttggctgtgacagggtctcagacggcccttgccgttgatgaccttgatggtttgaagagccctaatcaggtgcattgcaggacgctcctcagttgggatttgtctgaggctttcctcgtaaatagcctggggttatgggttttgggaggaagaccacacagataaatgccattctcatcatgtcataacaagggtacacacgctgctgacatgactcttcactgacagtggtggctgtagtcggctggctgaggtctccccactgtgaagtccccctctccatgctgtactctctggaaggacgtcgccatgcacagccgacacttaggggtatgggttgtgctccacttccgaggaggagaagtagctacatgagtgactgggaaatgtcctgggggggatactcatccatgcctccacattacttatgtactcaatcttttatttatattgctatggactcatggatactcagcccatgctcgggctggactccagtgtgactttgcttcttttcctgctcagcttcttcgaggttggccttggtgagctcccgtggtgggttcccagctcctgtgtgcctctgacaggtgctcatcacttggctttttgggcatctccttaatttctgctactaaagatgctcctggcttatcttctgcatgtcctgcctttgcccttgaatcagtcaattctccaagaagctctggctcctttcctagaacagtgttagaaaccaagatctgggcactggtgtgttcattgctagtgaggtgttgttgcttctagactctctcagctgatagagcaagggaatgtttaagccatttagaacataaatgcattcatttaaaaacatggactatgtattcactgtgccttgggccccaagctgggtgttgaggatcttgagaaaataaatcaaggaagcccatggtctagggtagtgctggtgaggagataacagactcttgagatggcactagggccatggcggagacagacctggacactagtgggacccagcaaagacccacagcagcctggggaggcggcttccagagtgctgcgactttggaacatgaatactcctgagggttcacaaacgagcctggggggtattccaggaccagctggtaggggggcaaaggttgggtcatgaactatggggaatgcaagaattgcaagaggttgaacatgcctgggggtgcagagacagaggctgaggtgcagggcagtctgagacatggttaggagcctgggcattctcttgagagacaggggagaagaaaattcagatggagcgttcatttcaggaaggccaccctgggatctgggcaggagatgaatacctggcagggtcagggaagggaaggtaattgaaagtttacaaaaacaaaaccccattcacattcttaaagtattcttcatagaggtactatttcaataaacacatgctttatttgtatattataacagatgaattttcttcactggcaatttctatctttaactgtcaaatttaagccttttctgtaat

SEQ ID NO: 465988 - DNA, 1989 bp, Homo sapiens
ggaccaagcaggcagcttcttctacactcatgccaaattccatgtcagtagtggcaaacctttacaggattatgaatacaaaatgccactggtctcctgaagatacagcagcaaaatgaaacatccacaaatatgacttaaattgagaatatgtgcatgtctataactccacccttcactgtgctgcggttgttctctggaccactcctatttcatcagtgttattgtcaacctgaagaacaagcagaaagaggctctctgaaatgaaatggatgcttatttgggaagagagcattgcaacgggaatacacatgccatcgtaaatgacaagaatattcagggagggctgtctctcccgatctgaaaccccaattatacctgtgaaggcatggcattctggaacaccccatttcaaaaggagaaattatatttgtaaaaattttcagaacccctacagaccataacaaagagtaatgtcttgaaaacaggctgagtttagttgatttgtaatcaaagtttaacctcttttaggaccccatcacatttggctgccatatctccttggactcctcttggctgtgacagggtctcagacggcccttgccgttgatgaccttgatggtttgaagagccctaatcagggtacacacgctgctgacatgactcttcactgacagtggtggctgtagtcggctggctgaggtctccccactgtgaagtccccctctccatgctgtactctctggaaggacgtcgccatgcacagccgacacttaggggtatgggttgtgctccacttccgaggaggagaagtagctacatgagtgactgggaaatgtcctgggggggatactcatccatgcctccacattacttatgtactcaatcttttatttatattgctatggactcatggatactcagcccatgctcgggctggactccagtgtgactttgcttcttttcctgctcagcttcttcgaggttggccttggtgagctcccgtggtgggttcccagctcctgtgtgcctctgacaggtgctcatcacttggctttttgggcatctccttaatttctgctactaaagatgctcctggcttatcttctgcatgtcctgcctttgcccttgaatcagtcaattctccaagaagctctggctcctttcctagaacagtgttagaaaccaagatctgggcactggtgtgttcattgctagtgaggtgttgttgcttctagactctctcagctgatagagcaagggaatgtttaagccatttagaacataaatgcattcatttaaaaacatggactatgtattcactgtgccttgggccccaagctgggtgttgaggatcttgagaaaataaatcaaggaagcccatggtctagggtagtgctggtgaggagataacagactcttgagatggcactagggccatggcggagacagacctggacactagtgggacccagcaaagacccacagcagcctggggaggcggcttccagagtgctgcgactttggaacatgaatactcctgagggttcacaaacgagcctggggggtattccaggaccagctggtaggggggcaaaggttgggtcatgaactatggggaatgcaagaattgcaagaggttgaacatgcctgggggtgcagagacagaggctgaggtgcagggcagtctgagacatggttaggagcctgggcattctcttgagagacaggggagaagaaaattcagatggagcgttcatttcaggaaggccaccctgggatctgggcaggagatgaatacctggcagggtcagggaagggaaggtaattgaaagtttacaaaaacaaaaccccattcacattcttaaagtattcttcatagaggtactatttcaataaacacatgctttatttgtatattataacagatgaattttcttcactggcaatttctatctttaactgtcaaatttaagccttttctgtaat

SEQ ID NO: 465989 - DNA, 2325 bp, Homo sapiens
ccaggagaggtgactgagggacagagagcaggagagcccaacagcctggacgcagaagaggccaacagtccggacgtgacagcaggctgtgacccggcaggggtccacccaccccagtgagcaggcccaaggcagcgagggcccacacccctcacatgcaaaactggcctcttctggtcactggtgtctgaaaccaaatccagaacagcctgtggcctgtaaagcatatatttctaacgactgcagactggtgggatgataggagccttctgaatgaccaggactgctttcttgtggagctgatgaaaacgtattcttttagcatgttagaaatcactcttgcacacttgcccccactgcccctttcctggcatggggtgagatcggtctacttcagcaaccagtgcctgcccttgatccctgcaggagctgaaggagatgaccactccagggtcaggctgacccagctggagggagagcctcattctgactacatcaatgccaacttggtcccaggctacacccgcccacaggagttcattgcctctcaggggcctctcaagaaaacactggagaacttctggcggctggtgcgggagcagcaggtccgcatcatcatcatgccgaccatcagcatggagaacgggagggtgctgtgtgagcattactggctgaccgactctaccccggacacccatggtcacatcaccatccacctcctagctgaggagcctgaggatgagtggaccaagcgggaattccagctgcagcacctcctcaggggctgtccctgcggtgtgggcatgggccggacaggcaccttcgtggccctgtcgaggctgctgcagcagctggaggaggagcagatggtagacgtgttccatgctgtgtatgcactccggatgcaccagcccctcatgatccagaccctgagccagtacgtcttcctgcacagctgcctactgaacaagattctggaaggacccttcaacatctctgagtcttggcccatctctgtgacggacctcccgcaggcgtgtgccaagagggcagccagtgccaatgctggcttcttgaaggagtacgaggccatcaaggacgaggctggcttttccgcacccccgcctggctatgagcaggacagccccgtctcctcaccaatgctgatcatgtctttgccacagggggagagcaggaaggaaagggaggtgcagagactgcaatttccatacctggagcctgggcatgagctgcccgccaccaccctgctgcccttcctggctgctgtgggccagtgctgctctcggggcaacaacaagaagccgggcacactgctcagccactccaacaagggtgcaacccagctgggcaccttcctggccatggagcagctgctgcagcaggcagggtctgagtgcaccgtggatatctttaacgtggccctgcagcagtctcaggcctgtggccttatgaccccaacactgattggggcaggcggggcgagcctcctaaccctatgtccatctccagaagcagtatgtctacctctacaactgtctgaacagcgcgctggcagacgggctgccctgagtcagcactggtcacggtgcaggagagtagagcccccggggcggtccccaccgacggcgcagcccgccgggaccgggagaaagcagctgcggacaccgcgcccgtgcgtctgcgcgcctggccgccaggtgacccagcagcccggccgccgagatgcccaacccgcccaggctccgggcgctgtgacttcgcgccgctgtgtgcgcctccccgagcgccggctgcgccccccagcccggcccggggcctaccgcctgcccggccccctgccactgccaggaggacggcatcatgctgtctgccgactgctcttgagcttgggctgtccgccataccgggggacctggatcccctgacggcttacctagcagtgcccaggatggtggctgagggtaaagctgacagaactggaggtggaggaagtagcaggccagagaggactcgaagatccttagaaggagccatagacggaaccataggaggcgcccaggagctatgggctccagaagtttcctcctaaactgtggtctcagcgaggctcattgacactcaccggggtttcgacattctccctggctagggcctgttctggaaatagaccaagggggagatggagcccctggccgtgggacatccaatctgatggtgatgagaaggcatgatgcctcttgttctattcttttttgtttcttctttttttttaaataaaaaagaccagtaatgtgctgacttcat

SEQ ID NO: 465990 - DNA, 1680 bp, Homo sapiens
gtgtgggtttgaggttcctcttctgtgaactgccaagatctcatgctcctccccacagccctcttctctgctcacacaggaagcccaggaagcctctgcctcagagatgctgccgctgctgctgccgctgcccctgctgtgggcagggccctcgctcaggatgcaagattccggctggagatgccagagtccgtgacggtgcaggagggtctgtgcatctttgtgcactgttcggtcttctacctcgagtatggctggaaagattctacccctgcttatggccactggttccgggaaggggtcagtgtagaccaggagactccagtggccacaaacaactcaactcaaaaagtgcagaaggagacccagggccgattccacctcctcggtgatccctcaaggaacaactgctccctgagcatcagagacgccaggaggagggacaacggttcatacttcttttgggtggcgagaggaagaacaaaatttagttacaaatattccccgctctctgtgtatgtgacagccctgacccacaggcccgacatcctcatcccggagttcctaaagtctggccatcccagcaacctgacctgctctgtgccctgggtctgtgagcagggaacaccccccatcttctcctggatgtcagctgcccccacctccctgggccccaggaccctccactcctcagtgctcacgatcatcccacggcctcaggaccacggcaccaacctcatctgtcaggtgacgttccccggagctggtgtgaccacggagagaaccatccagctcagtgtctcctggaaatcaggaaccgtggaagaggtggttgttttggccgtgggggtagtggctgtgaagatcctgcttctctgcctttgcctcatcatcctcagtttccacaagaagaaggcggtgagggcagtggaggttgaggagaatgtatatgctgtcatgggttaatctctcaggcctccagactgtacttccagatgtctcctcatccagttcctccacagtctgaatggccatgtttcttcttcattgctggagaatgaagtgcaaatgccactgcctggactgaaggcctttcacgatctgtcttctgctggactctgctcctgatcccccttctccttgcatcacccgaagtctccctacacccaccaggccaagccctctgtgattctgagactttgcatgtgtagttacttctcctgaaatggccttcctccccattcctgccaatccaggtccttatcatccttcaggttgtcttaaatgtcatccaggtgtgtgtatttttatgtaatccttgtatgatattaagcggagatgtggcatttgttcattaatttgtagacatattcagtaaccatactgaatacatataatgactatgtgccagcatttccgtatgtgcaagaagttcatcaatagatatagactcaaagagctctgtcatcaagctgttgttctgaagagcagaaggatacaaataaaaagaaataagtaaaatattttttcccatgttggatagagatatttgtttagagaaaaataacacagggaaataagcacagactatactgggaaacagtttctatatctgatagtggaaagaggtgacatttaggcaaagacgtgaaggtgctgaagaggcgggctctgagtctg

SEQ ID NO: 465991 - DNA, 5368 bp, Homo sapiens
gactgtggcttttggaccacacttcggattcacccgggcagatgattaaaaatgccggtttcgggacccgccctattcccatggaattagtctggagcttgggccccggagtctgcatgtctaataagcgtccctggggttaccaaggcaccccaaagtttaaaagagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgtaaaaattcactgtgcaattcatatgtcagcaataaaacatagattatttgtatataagttcatttttatagctattgttacatttaattaaatttattcaatatttgcttaaattaaaaa

SEQ ID NO: 465992 - DNA, 5370 bp, Homo sapiens
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgta

SEQ ID NO: 465993 - DNA, 5600 bp, Homo sapiens
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtgaacaaaacaacagaagattcccaagtttaatctgacttcaactagaactatgaagctcagtagcaaaactgagggagtggaactcttgctgcttgatttccagctaaagcctttgtattgcagagaagctaaggtgcagagaatgacgtcttttgctttcattagtcttgctgccttagacttagcaaaagaagctcatgagctaaaattagggatgaccagattcccaggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgta

SEQ ID NO: 465994 - DNA, 3069 bp, Homo sapiens
tcgatttagaggatcccccctcacggatactcaagtacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgta

SEQ ID NO: 465995 - DNA, 3070 bp, Homo sapiens
cagctcacagctcagacccaacacaaagaagaaaacaaatctgaaaaacttcttagatgacttgtaactaggtaaaggtgttatttatattgaccctttttaactctcgatttcacttatcacttttctctaggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgta

SEQ ID NO: 465996 - DNA, 5315 bp, Homo sapiens
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaagggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgta

SEQ ID NO: 465997 - DNA, 951 bp, Homo sapiens
aaaatttgtgtttcacgtaagccaaatgaatatatattgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgta

SEQ ID NO: 465998 - DNA, 1990 bp, Homo sapiens
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagatcagataaactatgtactacatgataattctcttgctattataaatattgaacatggttaaggacatttcggttttgtgcccatttctaacgctctttttttttgggacaaattgaacattccaatgggaaacctact

SEQ ID NO: 465999 - DNA, 1647 bp, Homo sapiens
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcaaagccccaaaaggggtaccgagct

SEQ ID NO: 466000 - DNA, 410 bp, Homo sapiens
tcaagttcttggaacaaattctgtgagtaaaactattctgttactaaatgtatgcttaattagcatatctagaattaattacttcttagaatgactttacctggtaaaggcaaattccctgaatagggcatttgaacagtcaacacaaattaagataattagaatactttgcctctcagtttttctgctgtttcttgtgaaatctgtggtattaactaatcataatagaatgtctgcatgtaaatgaatgcatacttgtcatttttattttctcttggtcttttattgcaacactaactttgtgtcctacattccttttgagtttcatgccttttcattaattaaggttgtttccatttttatggctagtatgaataatgctgctatgaagatttgtgtacaggtttttg

SEQ ID NO: 466001 - DNA, 653 bp, Homo sapiens
ttccaaagacaatgatgagaagattgtgcagaatgctatcatccaaacaataggtgagtacatttcacttttcaaaactatcatgtaaaacagtgatttacaaagctctcacataaggtcctggactattatagtacatttgtcaaagatgaatgatagcttaaatttctgaaaatttaattttcgaaaacaagcaagcatgagaatggaacaaagaacactatgttgttccattaaatctgcaggacacaaattcatctattgttgacattttatggcatttacttcttcatttgcttttactctctttttcctgcatctcttcctcccttctctctctctctgtttctttctctccctatgtgtgtctctttgtgtgtgtatgtatatgtgggaatacacacatacacatgcatatttttttctaaaccacgagatacaggaagttgcatacatcatggtctattaccactaaatactttgatgtatttttccaaaaaataaatgtactttttaatataaccagagtaaaattgtcaacatcactaaatttaggattgatccagtacttgaatcagcctttcatatttcagttttatcagttgacccaataatgtactatattgacttttttccttgaatccaagattcag

SEQ ID NO: 466002 - DNA, 5301 bp, Homo sapiens
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgta

SEQ ID NO: 466003 - DNA, 724 bp, Homo sapiens
agtaccatactatagaaggaagagcaggggctttgcatggagacctacctggattttaatccccagtttgctacttactggttgagtgacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcaaagccccaaaaggggtaccgagct

SEQ ID NO: 466004 - DNA, 5317 bp, Homo sapiens
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgta

SEQ ID NO: 466005 - DNA, 5106 bp, Homo sapiens
  misc_feature (5106)..(5106): n is a, c, g, or t
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagattcgccacagggttttcacacatcgagagcatgtggataaaacggtacn

SEQ ID NO: 466006 - DNA, 5375 bp, Homo sapiens
cccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtattttttttattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgaaaaaaaaaaaaaaaaaaaaaaaaaaaatttttggggggccttgggcccttgagaaaagcgtttctctataagaccattccggttggggcgcgcgcggggcgcccagttggcttatgtgtgacactggggccataagcggtggtcccaagggaaatccgcgggtcacatgagcacatatgtggcttgcgggtatctctcaccccattaaaaaaaacggcccgcggggggaacaccgaatgtgttctggaaccaattcccagatagagagttcccggaaggcaccacatcggggtttctatacaccgggggaggtcccaagagaaactctgatattataattatgc

SEQ ID NO: 466007 - DNA, 2814 bp, Homo sapiens
agatcatgtggttcacagagcgaagatgaaggccttggctttagagaatggtttctgtggcaccagaggcattccagtagggtatccagaagtcccctggtgccagcaaaggcttttgctgggggagaaaagagaactgctccgagttgctgggtcctggaagagcactgagaagccacagccacagctgtacgctgcttctgattgtttttcagccgcaagcgaagccaaaggtagaagaaagggaaatgcaatctccagtgaatggcaatattttgttttctctaatcctattcaggtggtgactgtagcaaaaaggaaaaacaggccaacatgcaggatggataaaaaccctgattattaccccaatgaatgccagttggctgaattgaattcaagcccagacttctgagtcttaagtgttgtccacgtccctaatcttcttttgcctttatatttgtgcagactcttgctaacctatctcatggcctctagactttcttttaccacactatggaaacaatgatctttcaaaaaaccaaaatctgatcatgatcatgccattcctatactgaaaacatacaatgttcttcaaaataaaacttaaatagccttcaaaataaaaaaatagccttcaaaataaaacttaaactccttagcacagcatgaaaggcccctgtctgtttcaccagtgtctgcctaatgcctgctatgtagtaagaagcttcataaaggtttgtagaattgagttggccttcaactacctttttcctttttcttaatcacaatttatgacttatctttgcgccacactatgctaggcatggcgttggcattagtaaaggctttctgattcacgggtgagaatattaaactattgttttcccacaaatcatatcccacaaggctattttgatgaacttaaacctctcaaagactggtgtagtggggatggaactaacatgttttagtcttttgtgggatgcagggctgtttttggaagggacaccacacactgatatccttgccagccattaagatggctttgatgttatctgtaggtagttatggaaagctgagttttatttctcagtcagacatttctgtttttgaagctccacttcttaggcatatacctgtgggtctccaaaggaccatgcactcacaactactgtttgctaaaagggcccttggcagcccgtgttctgtccttaagaagccctctgacaagctgtttgagttgcctgagttgcaggccttgccacatgactgatatttaagaatacaactcagcactttaaattatttacaccaactcccaacaaataaccaaccagggagaggtaaatatagggccctaggcattcccattccttcactgccactttaaacagagtttctcctatcttggtgatggattttgaccctggttataacacagcacctcccagagacatttcaaagccttaaaaccaagagaaaacagggattaagagtcaacaaatctgtcctcattttttcctcattttatttatcagagtggcctagctcccctctccaaatccaaagaacaagtgttcttcgaagaatggttatgcattctctgccttgtttcattccacctgagtatgaaagtggtggtggtgatgaacggagggtgaattacgtgcatgtttgtgtatcaagagcattcacaatatataggagggaaggccagaaagctgggctttcacatttaatctcttgtgtcagtgctctatgcccaatcaaaatatcccaattttagacaacttttgacatgtgaggcagtctgctgcaggccctagaggctgcagagatgtgcaagacatagttagaccctccagggacactatgagacatcagcaatttaaaagaagaaaaacttttttcaaaataaaaaatttttattacaaaattttttattgtaaaattaatttgctgtcataaaaattgatataaagtagaaatgtatagcaaagggagtaaaatttctgcatccccacctctaatctcatggacaggcactattaagaattttgctgtagcctttcagaatttttatgtgtatagaaacgtgcattcttatggaattgatgcatattacgctgacggttctctaagctgtatcattacatagagctatatcttatcctcgctttaccttcactggctgcataatattccatcgtgtgtgtgacataatgtcttgtcttggatggacacttcagttctcttttactcctttagaaattgtgttgcagtgaacatccttgttcctttattcttttgcacttgttaaaccagcttctgcttggggaaatcaaggaagatttcagagaaagggtgggatgtttgtagagctggggggcaggaaacagcatgagcaagagtagaaagaagagggtctattcacagctctggatttcattccagcattgcttcttccacatagcttcccctgaccctccctccaagttaggctagaggcaatgtcttgggacgccatagaactctatacttcctctcttaagatgaaaccagaatccatgcctcctagctgattgctaacagatacactaaacatctttgagttttcatgggccccactccctcccacctcctggtctttgcataaactgggtttatttggggggcttggaaatttttcccccattaatccatttctgtagttaactcttactcctcctcaaggttcccattccatcactgcctcttccagatagctttccctcacccttcctccaagttgggttagaggcaatgtctcaggac

SEQ ID NO: 466008 - DNA, 1285 bp, Homo sapiens
ttccaaatgtctcaactgcagcggccaggcgttcctccagaacctcctcccacaggaacttgctacacgtgctggaaatctggcaactggaccaaggaatgcccgcagcccgggattcctaagccgcatcccatctgtgtgggaccccacggaaaatcggactgttcaactcacctggcagccactcccagagcccctggaactctggcccaaggctctctgactccttcccagatcttctcggcctagcggttgaagactgacactgcccgatcacctcggaagccccctagaccatcacggacgccgagcttcagatacgcgcatgaaaggaagattaagaaaaacaaaaaaatgtaaatttactggacactgaatatatactaagtactgcttaagtgatttacatgtcaagattaaaatattttgctttactttaattatcatcatattcttcatccatctttcatttcatcttcatcatgccatttctttctccttcccctgggcctgaaattttatcaagaagacacacttgctgtgtgacttgattaatttacttaagcatgcccactctccttgggcaatgctgagaggtgacagcgtgctggcagtcctcacagccctcactcgctcttggcgcctcctctgcctgggcttccactatgggggcacttgaggagcccttcagcccactgctgtactggaggtgtggagggagaggcgccagcgggaaccggtgctgcgcgcggcgcttgcgggccagctggagttccgggtgggcgtgggcttggcgggccccgcactgggagcagccgaccggccctgccggcccgggaaatgaggggcttagcacctgggccagcggctgcggagggtgtactgggtcccccagcagtgccagcccaccggcgctgcgctcgatttctcacagggccttagctgccttcccgcggggcagggctcgggacctgcagcccgccatgcctgagcctcccacccactccatgggctcctgtgcggcccgagcctccctgatgagcgccaccccctgctccacggcgcccagtcccatcgaccacccaagagctgaggagtgcgggcgcccggcgccggactgcagcctgccatattgctgaaggtttgtgagacacagcctagaagtttgttatcaatcctcattggttgaggctcctcctgctgtagttgaagactgtctactgctaaaaggagagaatatactagaaagaaataaaattacttgatgtatttaattttttctgtt

SEQ ID NO: 466009 - DNA, 1039 bp, Homo sapiens
gctgtggcctgctatgacccgtgcctctctcccccacaggccggctggatcctgcaggcagctgtagccgttccctggccagccgggcagtgcagcgcagcctggccatcatccggcagcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgcccctgggtgcaaagccctgaggtggtcagtgccatcacgtccacctcacaggtgactcagagaggtccagcaactttcccggggttgcacagcaccaacacagggcggggtttgaaccatgggaagaaggattaaaagctgtctgatattttaaattggtatttctctgatgtaaactgaggtggaaaaccttttcccatgtttctaaggcctttgtgtcttcgcttctggaaaatctttttggtgatttttggaatctttttgagggaatttataaacataaacaaacataaaaatacatataatgtcctggactttaatctgttagtcacatgtcttctctgtttgtggtttatctttgcatttctttgtgacgtgttgaaaatcagaagttcttgattttaacggacatagttttatagttttctttacattttgcacccttagtgtcttgaataagaaattcttctctacaccagattgtgctcagttgcctctaaatattttgttgtgtttacctttcacattgagactttcatccagctggaggtgattttcttgtgtggtgtgtgcggtgaggtccagtttcattttgccacagcgcctggcctc

SEQ ID NO: 466010 - DNA, 1036 bp, Homo sapiens
ccagtgatgcgggcagcaggcccctcctgcgcacaggccggctggatcctgcaggcagctgtagccgttccctggccagccgggcagtgcagcgcagcctggccatcatccggcagcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgcccctgggtgcaaagccctgaggtggtcagtgccatcacgtccacctcacaggtgactcagagaggtccagcaactttcccggggttgcacagcaccaacacagggcggggtttgaaccatgggaagaaggattaaaagctgtctgatattttaaattggtatttctctgatgtaaactgaggtggaaaaccttttcccatgtttctaaggcctttgtgtcttcgcttctggaaaatctttttggtgatttttggaatctttttgagggaatttataaacataaacaaacataaaaatacatataatgtcctggactttaatctgttagtcacatgtcttctctgtttgtggtttatctttgcatttctttgtgacgtgttgaaaatcagaagttcttgattttaacggacatagttttatagttttctttacattttgcacccttagtgtcttgaataagaaattcttctctacaccagattgtgctcagttgcctctaaatattttgttgtgtttacctttcacattgagactttcatccagctggaggtgattttcttgtgtggtgtgtgcggtgaggtccagtttcattttgccacagcgcctggcctc

SEQ ID NO: 466011 - DNA, 1596 bp, Homo sapiens
aagtcaaggctagacccgtgccctggaagtgggaattgtcttgcttgttactccagtgaagaaagagaaggccacaacatcaaagccacacccacaccccaaagggagagggagtcactgcagaagcaggcacaggactgtgtgcaggaggatggaggcgtctgtctccagcctgtgtgagtccgtcgtgaacacttgagcactggggtctttcacgccacctcccttctggaaagcactaagccagcgtagtatacttaccaactgcctctgtctcctgtcaggcaaaatgcatgttcaggggaaggcagcatggtggagttgccagcctgatgcggatgttgattcttctaccaccaccaagggggtgggcccagacccggaaagtgctccccagctggggcacctggtgggacctgggtctagagcagcaaatcaccacaaattccagctcctggagaggcctccagtcaggaacttggagcacctcctctacctcctttggccttttccggggccctaccctacccagggctcagcccagaatcagttcagccttgagtcaaataccccatcttattttcagaaatacagaaggggcaaaagggctccttcaagcctcttccgtaaggacattgatcctaggcatgagagctctgccaccttccaaaaaatcctcacctcctaatactattgtaccaggattaggtgtcagcatacaaatttggtgatgggaggggggacataaacattcagaccctagcagctggcttctccaagcccccattcagagaagagagaaaaagaataatgtttcgctgttctgcatatggagtgcagattcttgcatgtcagcacgggtgagggcagtcctgcccagaagcagagatctagaccaaatgaccacccagttccctttaagctccgagcaagaaaggggatgttctcccattttgcagtggctaaagaaggcaagacagtgacccagctatgctctcccgcagtcagaggcaaggagctcacgaggctggagtcccaactggaccaagaagcgtgttccctgccccttcagctggatggagacatttggagggatgccctgccctagcccacctcactctcaccatgtcaacaggacttctatggaaatatgcgtatgatgagaagcagatctgagttctagaaagggagggaacagcttgtatcaaatggttctctatgccaagaaatgtgctaaagggctctgtgtgtgccatctcatttaaataccttcacaataattctgttggggtagattttattattatgcttacaatataaatttgaaaatggggtgtcaactgcttcactaactggctgggtatccttgagttgagtcattttccctcttggggcttctttctcatctgtgcaataaagttgttggactagatgcttgataagaacccttcaggttcaaatccctgtgaatcatctagtgatactgttgcccaagcagcccaggctgttctagcccatgggaagggtggggtgtgatgggtcaccagcatttccaaaagcaatgagctatgtatgaaggggtctacttaacttttt

SEQ ID NO: 466012 - DNA, 1880 bp, Homo sapiens
cattgaccagagaaatgatcacactgagcttccgaaccacacgatctccgagcttattgctgtatgtgagctctttctatgaggaatacctttcagttatcctcgccaacaatggaatgtttgcagattaggtacaagctagatagacatcaaaatcctgatgcatttacctttgattttaaaaatatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttaggtcgttctggaccagcggatgagggagagcccttggttaatgcagacagaagagactctgctgtcatcggaggtaacaaggccctgaatgacctggtgcttgtcattatcgctttagataatgatactattacttagcacaatgggaaatatatgtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcacacaagcaggtgcagtgctgtcacctggctgaagacctgcagcctcggagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttagcatttacatgatgtttattaaa

SEQ ID NO: 466013 - DNA, 582 bp, Homo sapiens
caagagaaaaaactggtaatcttattacagcagatgaatacagttttatttctctctcaagccctgctttgcctgttgcttccatcctttttgactttagtatctaacaggaatggggaggcatattcataaatatctgttacgcaaggtagaaagttacagtaattgtctatcatattgtctatcataacctgttgtaaaagcacagttagctttacatttaataaaggaactgaggaaagtaatcttttttaaaaaaaacccatcttatgtaactcaattaagaaaatgaactatactttaatattaggatcaaaaagttgaataatatttattatatacatctttgtttccttccaaataaaggagaacatggaattgaaggtgttaatgttttcattcaaggatggtatattcaaaggcatgtaacttacggtataaaaatctacattgaaattcagcaacgaagtatatactcagaagcaattgatctcagaaaattataaatattcattttgcctgtccttggaggtagagataatcatcaaacattaataaaacactttatactttgaaaaactg

SEQ ID NO: 466014 - DNA, 652 bp, Homo sapiens
cattgaccagagaaatgatcacactgagcttccgaaccacacgatctccgagcttattgctgtatgtgagctctttctatgaggaatacctttcagttatcctcgccaacaatggaatgtttgcagattaggtacaagctagatagacatcaaaatcctgatgcatttacctttgattttaaaaatatggctgatgggcaacttcaccaagtgaagattaacagagaagaagccgtggtcatggtagagaatgagtacgtatttaagtttaaaacagccagttccatctttttcatggattctgccaattatagatccttccattatgaagaagagtaaagccagcaagttaaccagagcgcaaagaaacaagtcatcttgtcctcagggacagaattcaacgccgtcaaatctctcatattgggaaaggttttaggagaacatggaattgaaggtgttaatgttttcattcaaggatggtatattcaaaggcatgtaacttacggtataaaaatctacattgaaattcagcaacgaagtatatactcagaagcaattgatctcagaaaattataaatattcattttgcctgtccttggaggtagagataatcatcaaacattaataaaacactttatactttgaaaaactg

SEQ ID NO: 466015 - DNA, 339 bp, Homo sapiens
ctttctatgaggaatacctttcagttatcctcgccaacaatggtgaatatcttttgtgtaaagaaaaagagaaccctgagttagaaaaataggactgtaatgacatgggtcttttcagcagtcaaactacaaacgatgagagaaaactgtatgccctccaatgggtttggtttttcagtgcctcccttaatggttattataaaagctagcatttcaagattaaattaagatgcttttctcccattacatgtttgataatttaacggagttgatatgcagttatatttcttattattgataggatgactttaatagtacatgatgactcaaattggtttt

SEQ ID NO: 466016 - DNA, 353 bp, Homo sapiens
ccactgcactccagcgtgggcgacagagtgagaccctctctctaaaaagaaaaaagaaaaaaaattatgatgttttattcttttctctccctaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcaca

SEQ ID NO: 466017 - DNA, 539 bp, Homo sapiens
cattgaccagagaaatgatcacactgagcttccgaaccacacgatctccgagcttattgctgtatgtgagctctttctatgaggaatacctttcagttatcctcgccaacaatggaatgtttgcagattaggtacaagctagatagacatcaaaatcctgatgcatttacctttgattttaaaaatatggctgatgggcaacttcaccaagtgaagattaacagagaagaagccgtggtcatggtagagaatgagtacgtatttaagtttaaaacagccagttccatctttttcatggattctgccaattatagatccttccattatgaagaagagtaaagccagcaagttaaccagagcgcaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcctcggccgcgctgctcccttgaaggcggc

SEQ ID NO: 466018 - DNA, 3122 bp, Homo sapiens
gtcctctggatctggtgtccacagtttctaaccagtgcctgctacgtgaacgaagggatcacctctgagccatggctcatcactctggcagtggctgctggacagccctcacaggtggatccatgtattttgtcattgtgcactggtgccaggtcatcacacactggtgtcaggtcatcacacactggtgccaggtcatggcacactggggccacgtcatcgcacactggtgccaggtcatcacacactggtgtcaggtcatcacgcactggtgccaggtcatcacgcactggtgtcaggtcatgacgcactggtgtcaggtcatcacgcactggtgccaggtcatcgtgcactggtgtcaggtcattgcgcgctggtgtcaggtcatgatgcactggtgtcaggtcatcaagcactggtgccaagtcatcacacactggtgtcaggtcatcacgcactggttccaggtcatcacgcacaggtcttcacacactggattcctggtgttcaaccttgttctcgccctttgcgaatggttccagagctgcttgctgaatcctgggctcagaacctcctctgtgacttaggtcattatgagaacgaatatacataacaaagggtacccctgaaagggcctctgaccccagctgtttagatccatctaaacatgcttgaaaatacacaacgtaaaccatctcccttgttaccttggaaagcagtaaggattctatgcaggttgtgctaaggagatatttaagaaaatttttttccatactaaatgtgttcatttgaaatacagagatcatcttctcatttctataaatgggatctgacaggagaagctcccaaatataagaagtgtttcttccactgcattcaatggaaaatggagcacgctaaacagtgctagtgaaacagacattcgtgtgcacacgcgtgcgtgtgctgtgcgtgcacatgtgtgtattattccacctgcaaaatggaaattcttagaacacctttcagtatacatttcaaataatatcacaattaatgactggatttcagaaaatggcttctttccagatcatttccacattcagtgtaaaaagtgttcttgagctttctgtgcccttgcaggagatgaaggcatgcttgttccctaacagcacatttttgagggaaatccacatttgcatctcactgttggcacccacatctgggatgcccccacagctgccccgacaacccatctctgggctcttgactgcagaggctcggaaacgccatacccttgaccgcagaggctcggaaacgccatacccttgaccgcagaggctcggaaatgcgatacccttgaccgcagaggctcggaaatgccatacccttgcttggctgccctcctggtgctgacggtgcctccgagatgtgaccccgctccagctggtgagtctatggagcacctgctcagtggcttctgagcagagtccggccttctccatactgatgactgctcttcctggagcccgtggcaggtggggctgcaatggctgacccacggccagctgagagtgagagccagcatgctcagatgcatgacgctggcttgggtcccaacggggctgaccccaacccggtgtggacaacctcttctggctctcctctgccctggtcccagtgcagctaacagtgacccagccatgacaacctcctttgccctggtcctcgtgtagctgaccccaacccagtgtggacaacctcctctggctctcctctgccctggtcccagtgcagctgaccctgacccagccggaccaaccacctccggctctcgtccacttggctctacccgtcctttgctataaccaggactgggcaggtttgaaggatgtgccaccaaaggcttcccaaacagaacacgaggagaaggcatcttaataaggcacctcccacgtaagtctgggtgcttggaagtgcaagaaaggccttctgcaagatggcaagcgtagcactcgtgtagttgacagtgtgttggggacaaagactggaacatagatttcttaatgcaaaatgctaaaaggaaatgtagagtgtgtgccagctgggaggcggggagtgagcattgtttgtctggagagcagagggtaaagggggaaaggcattctgggagagaagtttggggaagcagagtgggaaactgtgagggacaccccagacagcttgatgtttatgccacaggcaaaagaaaagtactgcaagttcttaatcagggacttgtgagctgggagctcaggacggtccctgtgcgtggggcctggaggacaaggtgcctgaatgcaggaagtggtgtcctggacacagaccccgagaggctcctgcagacttgagctggtttctcatgagacaccaaagggcttggattttagggacagagcccacaggaatgaggaatgtgttagaggtgagatgattccaaggtgcctaaacttctcccaacaaaggcaagatctatgataggaagaaaaacaggttttggaggttggacctgagtttgatttggacctgctgattctagggcacttccaagaagtctgtgaaagaacaaagcaagtgtgacgggcagggctgtgaacctctgagtgcttcagatgtaaaagtgtggaagacgtcgggctgtgagtgtcacgcagcagaaaggtggaggaggcctctcgggtcggaagtaacatggtgcgcagaaggcagtttgtatgcacagtggagcacatgtgttgatgcctgaaagcccacattgagatcctggctcaacctctcgccaacggtgtcatttggacaaatctcttaatctatgcaacgtacaatgaggacagtagtcacaggacataacttatggagttctgtgaatataagggaatctcctcatctttgccaccggtggggtaccctccccactcatcctgaggtacctgggagcagacagacatgaaacacgcatcaactttgtcactgagaacggcagcatcagctcctttttggaaacaaatcctctacaattccataaagatacacctctttacagtcatttatcagttaaagtcagatgtataaaaatgcatatcctaaaaggaaatgaatataaa

SEQ ID NO: 466019 - DNA, 1228 bp, Homo sapiens
aagaagatttcctttccccagtatatgttattatcagctttgtcgaagatcagttggctgttatttcaaaaaacctgtcttcaacttctaaaattatttctttcacttgatctagtctattgtggaagctttctaatgtattttgtatttccgtcaatgcattatttagtgtcagcgtttctgtttcagttgtggaatgctcaggaccctggattttgtgctttgtctcctagtgggagcaaagccagatggagccagcctggggaaggacgatcatcaggtacttggcagaaagctcaggtgaggggtgacagttgctacactgaagtcctagcaaggggaaagtggggccatccccagtggccacagtctagagcaggggatactgtttccctttctgagaagataatcaatgaccctccaagacttgagaggagtgacctgagtttaggagatagtagaacccacctagatcatggtcgtgccagcaaatccgtgtgaatgccactggattaaaagaaggaagtttagttgaatggttactaccctcattcacaggagcagttatcggcacttccactgaggcaatggcagtgggaaaaggaaggcaaatatttattcacccatccataaactcataaaaattgccaactttacagagaaactgttttttccgtttttgaagaaagcctagcttgtctacctgggagctcttattcaagccttcacttaagctcttgaatcctccaacgaagtgctgctcaaaccttcttgtcccgaattacactgtgttcttggatacacttgcatcccacatacatttattgtgttctaaatgtttctggggttgctgtggtttcaaatacttattgctaatctgcagcagaaagttttaactaaggttactagttaaagggagggaagagacatgatcatgacagattttactgttttatatatggtcacaagttaccaatcaaaccttatatttttcttatttataaaatggaatcattatatacccacctcatgttcttcatatttataaaataggaccattatatacccacttcataagcttgtcatgagaattataaaaactaatacacgttataacatgtagctttcagtgtatcaggtatttaatacatacaattattctttattctccaggatgtcctatcataaacactacattaccattagtctggttagctcatcctatcat

SEQ ID NO: 466020 - DNA, 997 bp, Homo sapiens
aacagactaatacacaaggtttgagaggatggactccagttttggagaagttctactagtacaggaagtgtatacaaaagaatttcgaaacaatccttttttcctgtctgataaggatgatatctatccagttgacactgttgctattggcagaacagacattgaagacttagacctttatgccacatctcgggagaggcgatttcgtttatttgcttctatagaatgtgaagggcagttattcatgactccgtatgattttattttggctgttacaacagatgagcccaaagaaacaccaccagtttggaaaggctcatcgaagctatttcgaaatcttaaagaaaaagagccacatgcagggttcagaatagctttcaacatgtttgacactgatggcaatgagatggtggataaaaaagagtttttggtgcttcaagagatattcaggaaaaaaaatgaaaagagagaaattaaaggagatgaagaaaagcgtgcaatgctgcgtgctgatgacatcacaagtttagtaacagatactacacttcttgtacacttttttggaaagaaaggaaaagctgagctcaactttgaagatttttatagattcatggataatctccaaacagaagttctagaaatagaattcctttcctactcaaatggaatgaataccatcagtgaagaagattttgctcatattcttttacgatatacaaatgtggaaaatacatcagtatttttagaaaatgtgcgttacagtatacctgaagaaaagggcatcacatttgatgaattcaggtcatttttccagtttttaaacaacctagaagactttgcaatagccctgaatatgtataactttgcaagtcgttctatagggcaaggaaatttcagaactcaaccagagacctattcttccggataacgacattgatggagaatgtttcgacccaatcaactgtatacagagacatccttaggcttttgaaattat

SEQ ID NO: 466021 - DNA, 6160 bp, Homo sapiens
tcagctgagtggctgagctgccgagctactaattgcagagagcaggcagatctaggggagccctcgggctgggctcatggcctggatgctgcccctggtctggttccatcctgtctgtggcctcacagcaatcagcattggcagccaaagctcccagggaccgcagggcagtccccacagagccccgggctgctcctgagcttccctggacctagagcctggcctctcctaggccctccttcgcaaacccacccgtcatctctactaagttttccagagctagatgatacgcaaagaccatgcagtctagaagtgtcacctttattttacttggtttgtttgtagtccaaaggctgggaatgggtgggggcgggagcatagatgctcctaacagagaggacacgccgtctcggtgagcccagcgtggcagccttgaccaccacaatgcccaagcagggcctcttgggagcagaaggctgggccacttccctgctcaagcttctggtgatgtcccagaggaaaccaggaggatgtaaatctgttctcaaagaacaggccccgacactaggcctcactgtccaggactgctgggaccaaggtgaaccaagcagcgcatttcctggcagcacacagcagccacggctccacaacactctcagtgggctgctgtgcacctgcctctaccattgcccagctgttccatgccagcctccttgggactgtggtggagcgcccccacctctcccacctgccctacctcagctggtctctggaggagaaaggatgccggtggggaaggagggtggctgggagaaggaggggaaaggaaagcccatgcatctgggcggcgacttctgctctggaaacgctgatctgccagcccaagtgacggatgtattgagttcgtttctgcaggctcttggcctctgcctggtccaagggccaagctacagccaaacatctaacacggccactcccaaattactggctaaatgttcgtctgccagaaaagaggagctcaggaacaaaaccttgggcctgggggcaacttgactcttctcatacactgagagggcaagaaaggtcacgggcttcatttttaagagccaaggaaattgagaaactagacaaacaaccagaaattctcagatagaacttatttataccccctccactttcatcccccaaccttgttctctttccagaggcagtctatggacttgtcaacaactcaggaacaaagagaactctgcccaaggggacggtcatgccctggccccagcactttgctgggggcctggtctgttgtaagcacacaagcatagtttttgaaataatgaatgaatgaatgggtgggtgactgtgtgaatgaggatggttcccagaataaatcctcaagaaaatcttctttggaaagggtgaagtgtggagaagcccgtgacctgtgttagttacattataacagatatcaatgtttcccaccctattgagtgtcccagccttcaaatcaaatcagaaactcctttcaggctcctcggggtgggtagatgagagctgaaggaggaggagaggcaaatagggaagagctgaccaagatgaaggtcagaccttcatgcccacatgagctctacgcacacttcagtccttttcccagactgctcagtgcttccctacccaggcactccctcgggaaacaagggaagatgactacatggagaagataaccaggagcccgaccaggcttttttttttttttttttttttctcttcgaattgctaagtgtagagtgactcataggaactccagacaaagatgacgatggaaaaggagtctagcagatcaggggaggtggttgaggtaaaagaagcgggggtacttgaggttgggagagaatgggaaacatgttttgtaagatttccaagatttttggaggctgttgttaaggactttttcataagacctgttaccctgctggggtttacatcactatttgatctaagccccaacaggacgactacatctgctactaagctgtgttgtaaatgtctttaatttttatatttcatctgaagggagttgttaaagtgagtttacagggtgatggctctttgaataaaagccatcaatactggagcagagctctgtatgacacttaattttcgctctaataagccctcctaaaacattacaagatttaggagggattgtttttcctttcttctttttccctttgacttcctttccctccttgcattatttctctcctctccagctctcgcgctctcctctcttgctttccttaaaggacatacttgaagagaacatttgtgctcagatgacaccacttctctttttaccgccagccagatgtgctcttgacttctgaacaggagaaaggtttctttgaagtttttcaaagactttgcttttatttagaattttttttcccttttctctctctccctggtgtttaactggttgggaagccccaggaggggttttcgcatgggcctcttttcttttcctggggcatgaaaggaatgggatcagaggcacaatgttcccagagagccttctattttctgccccaatgactccaagtattttctggtagagccgctgtccccaggagcaaaaagaagatggctttggattttccctggaaacgcatctattaaatgaacagaatggttctggtagtggtgcaggggtgaagggcacccccatcccgtccctgaacatctccctacccttcctaaggagggcagagagaggtcttcactttcccggccatgctgctgtcatggttgcttaactgctcttgcgtggcactgaaatttgattaaaacaaagatcagtaatgggaattcaggggacgtgtcagaaaaagaatggtaccccaaagtgagagcaggagcccctctgaaagtaatgagaaagctttatctttgcatccctcatagcaccacagcctggcatcctgctcaatatgcttgggccagtttgtgatttttcaggaggactggaaaagtgctaatgctttaggaggtggcagtgacagaaagctggaagacttctctgaagaacaggtgagtctttagcatgacatgctagggcggaggatttggagtctcaagtttccgtcaaagtgccagctgtgtactgagtagctctgtatctccccaggtgaatataagttccagaaaggcaacatccccgccattgtattcccagggccgagaagagtgccagggactccatgggcacatggaaaatgtatatgtcctccatgcatgtgtctgtttcacaatagccatgatttctttggaggaaatgatgctgcaaattcaggagggaggggttttctctcagagtactttcaaagaaaataggaactgggggccaccaaagacttcttatgccacaaaagtatttgtgttttctaaaaaacctctaaggtttttgaggaaaataaatacatttggaattgaggggcttgtttttgttttatgcaaaaatagattaattaaaacccaggagtgtgtgtgtacacgtgggtgtgagcactgttttttgtttgtcttatgtgaagtgtgttcactactacagataatcatagtcaggctcatttgactgactcctaaagacgaaaaccctaagtcagaaccaatcacgttcatatataccacgacccacaagcctgaaatcacaacaccaaccttgggagtgattgggtgggttacaaaaattattctccagtctcttccttccactaatttcttagcagcttctatgttcttaggggcaatgtggatatgtgacttctgacacatgggtatggtcgtactggggccatgtgattagttgaagccaacagaccatgagtggtgttggtcacttttgggtcaagtcagttaaaagtctttgtgtgtatcttccctccctctcttccggtacttcagcatcccatgaggccacgtctttcaaatggtgctgctagaagaccacagagcctctttcaacctgagtccctgagcatgatgtggggcctcttgctaaccagtcttggatgtaaaacatgagcaactcaatttttgtcacgataaatactgagatttcaagattaatttgttatcacagcatggcccagcacatctgattaatgcacccttaatagtctggccaagctatcaaacaaacaaaggctctccttcccaaatgtcttttgcatctattccccttcatttcaatggccaagattcctgtttggaccccaacttctcagtggtatgattacgctaacattccatcagccatcctgctctatttcttcccccatgtagaaatgtcattttccgattccacaccctcaagcatggcttaatatcatgtcactcccttgcttaaactggctctcaataggctgcaaaataaaatgtaaacactgaagccaaccccacaaaaccctccgtgatgaaaactgaacgctgtctttccaccttcttttcttaaattcctgaattaaatgactccctgtccatgatccctcactgcacattgtcacccctctccattgccacttactcctcccagaaggctcgacccttctcatcccacaacccagctgttcctgatgtcaaaggctccagggccaagttctccatgacaagttttctctttgtagccccaccatgtagatgagatcttgcccttatgtgaagtcccacagccctcatcctttcctgtgtcaattaaccccttacacagagcagttttttggtgtgtttcactgagcagttctaggacatctttaactgcaccactctcaccactttcataggagctagcccagtgccatacgtagtagctcaataaacttctgctgaaagaatatatgaagaataagccagtatctcagggacctagcatgattgaagcttactatttgattgcctgtattagcctattgcgtctttaagcctgctattttgagaatatggtttggaaaccactcccagggtgtttgtacaactctagctctggaaattctgattctatagctctagagtgggtctcacgaattcacattttaatacaaaggtctttttaaaaaaaagacattttaaaggtctttgaaggagattctgatgtgagagatctgtaagccacattttgacaaacactagggtgctgtgagtatgtgattgtgaatgctcttagtgtatgagggaaatgcattggtagtttgggtcgctggtgagcaatcctttccagaaatggcaagtacgttttatctcacttgtcaacaccaacgcattggtaggggcgctccagaggactgttttaaggaggtctctggggccacatctggactgcacagggagaagccctatgatggattgatgatgtctgccataggagaggggaatgtggggcctgtgtgccaggtgtctgccgtcactgccagcccattggtctggagacacaggaccaatacttggagatgaacatcaaaggatcatctgagtcctaatccagcctgcaacctgacttcaacttcctcaggtaactgtggcaagcacaaataagatcaagatgtccagtaaaaggcattcctttagaagaagccacaaagttgtcatagtgaacaattgctgttttcatctgcagcctccatcttcctccttcaatggtaccttgagtttcagcaatttacccctcttccattctcttctactctggttccaagtgggcatgggtgggaatgaccacacccccagttccaggggtgggtcctgattggctgaactcaagcagcttatcctatctccccagtgacaggagcaaaagagagagacgcccaggacttgtaggagctgcaggaggaccctctcccttccgcatgaggagaggcatgagggtgtgaactctgaccagctagagtgattttgtaaccaccagataagaaactgcagctgctgaggggccactctgagcagtccaggaatgaagtcaacaccacaaaaggcagacgagcgagatggtgagaaaccaggtcctggggtatcctttgaggcactggaccaagtctgacctgaggtctgtctgactactggactcttcagttatgtgaatgaatacattttcttcattatctaa

SEQ ID NO: 466022 - DNA, 933 bp, Homo sapiens
cccaatttgctaataacctaaaacttttctaaataggaatgcttcaaggcacagtttgcaagtttaagggagcacggctgggcatatccactccctccctgacatcaatgccattcggcatgagattgtgttgccctgggctctgcctctttaagccgtggactggcatttgctcaactgaatttgggcagggacggcaatggagcatcagggaagaaagctgtgggggtggcttcccatcaccaaagaaagacccaaggatcaagactgagcctccaatctcattgtctcctttattccggggaccatttgattttgggtggactctggatcttaccacctggtcacatggaaataccctcggagaggaagagaacatttaccaccttccaataacaacatctagagtcactaccgcagctcctgaatacaaccactcagagtgccctttaaattctgattctcattcctgtccatatattctgatccaggagatctgggatcccagaaatctacactcattaatatcacttcagatgatccagatacatgagaagcaatgataaagaaaacagaatttagcaatgtgtgcagtatattttacttaatcctgcaagcaatgctaaaaggccttctacaattatcatgtcctggaattgcttcagatgctggtgacaggaggagtaagttctcagctggaacaacatttagataaggataaagtctatggtgtggcagatagctgcacgtcgctcttgtctggaagaaaccggtgtaagctggggcttctgtccttacacgaaaccattttatcagacgttaatgtgagtctactcttctcagaattcagtttctcacttctttacctctctgagcttctgaaaatggtccaggctatttgggttcatagatgtcccatagcacagaaatgat

SEQ ID NO: 466023 - DNA, 1057 bp, Homo sapiens
ataggaaaaatgcaggcaggccagcgcctgctcctgaatgcccgtttgagcaatcgtataccctacaaattcagctcgtcactttttttttcctggtggtggcggcaagaagttggacgggtttctggggttggggatgtgtcatggaagaagtggaagttgacgtacaccttcaaagagggatacactcttagtcgacaaaggaaggatggacttgtaacatcattcattgagagctcagatgggaatcatattttggaatttgccctaagacacccagccacccattgctttcctgggtggcacacctctcacaatggatggaagcaccaagttgccctaacaccctctcctaacctcctgactggctcagaacctatcctgtctaagaataacagtgtctgctgaggaagggagagagtttctcagtcagtgtaacatttaccatataaattcctattctgttgacctgcacatttacctcctttgaaagttatggttttgtggttagccgagtgctaaaaacctataggtttcaaacccctcatcattgtaagtttaccaggaggctgaagatgaatagaatcatcaccctagtgaaatccttcagttacctatacctgcaggggctcatcttaggaatcatagaatatctcatagcttaatttttaagtttcacaatgatgtttatttcttaatgcattgtcatagcttgttctaaccttatcaatgtaataatctatttaaatcaaaccaaacttattatacacttcagtttagtctgcttactttacttccatttttttgaggatatattccaagtaataaaattccacatgcagagttcaaataaaggcattgaatcagcccttgctgttctccaggcaaagacatgcttattccagtaactttgccaggtgtacgagtgtctgcagttaacccccttttgttctccaaaggtcttgctttatcacccagcctggagtgcagcgttacggcctcggcttactgcagccacgacctcctaggctcagtgatcctcccacctcagcctccc

SEQ ID NO: 466024 - DNA, 867 bp, Homo sapiens
gaccgtcacatagctgcttctcacacttgggtgtctacaaaatggccacgatatcagttgctatggtaatgggcatcctgcaatccaggcagaaacttcctagtgaccaccggatggcccttggtggagcagtcatctgcagggattcccttccttgggagcccctcgcaggcctgaccactcactttactctcaaaatctgccaaaaggagaactacagagaagccaagcagggaaatggacaggtggcagccaagaaagcagaaccccaactaaagccacgagagggtggtacgtcatggcggaaattcaagcccagaagccttaaacctggccttgacaacatgctgccctctgggttcccttttaatcagccccacaatgccaagttgccaagcaacggatcttttatggtgaatcgccacggagactgatgtaaacaaaatcataaatcccattaccctgctaaatactaggtctgggttagaaagggagcaaaagagctgcttttcaggttaaaagagatcatatgaaacggagtggcaaattcaaattctcctgaggcaaaggcagttaacaccagtatataaggccagcctggtggggaccgaggtgagtgggaagcaatggcctcatctgaaaggggcgtcattggctgctgccacacaggagtgtggactgcaatcaccaggtctcctggacatctaggacattccaaagtttcagcatttgaggttctgcaagaagagttctgttgttgacaccattgggtcaactggagactccacagagttgccacagagctgcagtatggagcattggtttctttcttgagttgtgctaacaaaattaaagatacgaatttaa

SEQ ID NO: 466025 - DNA, 4233 bp, Homo sapiens
  misc_feature (1)..(1): n is a, c, g, or t
  misc_feature (4)..(5): n is a, c, g, or t
  misc_feature (12)..(12): n is a, c, g, or t
  misc_feature (14)..(14): n is a, c, g, or t
  misc_feature (16)..(16): n is a, c, g, or t
ntcnnttttttntnanagagatcaggaggaacaggccgaacgggacaaacgggataaaaaaagaaggccaccactttagtcatggccctcagtcaagcggactttggaggctctggaaaagggaaagcctgggcaaatctaatgcttaatagggcttgcttccagtggtgcctggggcaagcgccagcccatgccatcaccttcacggagccctgggtatgcttgaccactgagggccaggaggttaactgtctcctggacactggtgcagccttctcagtcttaccttcttgtcctggacaactgttctccagatctgtcactatccgaggggtcctaggacaggcagtcactagatacttctcccaggagagacgttctagcaaaagcaggggccattatacacctgaacataggagaaggaacacagtagaatggacacctgaagcagaagcggctttccaggccctaaagaagagcctaacccaagccccagtgttaagcttgccagtggggcaagacttttctttatatgtcacagaaaaaacaggaatagctctaggagtccttacacaggtcctagggaccagcttgcaacctgtggcatatctgagtaaggaaattgatgtagtggcaaagagttggcctcattgtttatgggtagtggcagcagtagcagtcttagtatctgaagccattaaaataatacagggaagagatcttatcgtgtggacatctcatgatgtgaacggcatactcactgctaaaggagacttgtggctgtcagacaaccatttacttaaatatcaggctctattacttgaaggaccagtgctgcgactgcacacctgtgcaactcttaacccagtcacatttcttccagacaatgaagaaaagacagaacgtaactgtcaacaagtaattgctcaaacctacgctactcgaggggaccttctagaggttcccttgactgatccctacctcaacttgtatactgatggaagttcctttgtagaaaaaggacttcgaaaggcagagtatgcagtggtgagtgacaatggaatacttgaaagtaatcccctcactccaggaaccagtgctcagctggcagaactaatagccctcactcaggcactagaattaggagaaggaaaaagggtaaatatatatacagactctaagtatgcttacctagtcctccatgcccaagcagcaatatggagagaaagggaattcctaacttccgagggaacacctatcaaacatcaggaagccattaggagattactattagctgtacagaaacctaaagaggtggcagtcttacactgccagggtcatgagaaaggaaaggaaagggaaataggagggaaccgccaagcagatattgaagccaaaagagccgcaaggcgggaccctccattagaaatgcttatagaaggacccctagtatggggcattgatagcacccatcagatggccaaatcattatttactggaccaggccttttcaaaactatcaagcagatagtaagggcctgtgaaatgtgccaaagaaataaccccctgccttatcaccaagctccttcaggagaacaaagaacaggccattacccaggagaagactggcaactagattttacccacatgcgcaaatctcagggatttcagtatctactagtctgggtacatactttcactggttgggcagaggccttcccttgtaggacagaaaaggcccaagagtcccacatgaaccctcctgagctgaagcaaaggacccagacctgtctgtggagctacttgagccccaaaatgctgcatcccaactgtatccctggtctgtcctggtctccctcttgggccaccctggttgctcctgtcgtgtgggcctggctccaggctgcacacctggctcatcaatgccgaacaagctctgccagctgctgcatgattgttgacactcggcgtgcactggctgtttgaccacatcccggaacactctttgctgaaaccgacaaagtaaaatattcctgaacatataatgtagtactctggggggaaaattaaacattttagtggtatattaaaaatagtaaataaaatttcagaaaatttcagaatatatcacattgcctagtgcaatgacctaatagaccagggagctagcaaacaagaaaccagtattgcaaaagtgaaatgattttcattgtaaacatataaaatgcagttactgtgaacaaatataatccccaaacaataacacttttgttatcagaactctgttaagtaatcaagaacttataaaacaatgatttttttgaaaatgccccctttggagaatacaagcatgccctgtatcggcatagcacttttaaacactttcatgtctctgatcttattatagccttaggatgcatgtgaaactcatgttttcgtagacaaagaggttccctttataagaagcacatctgggactctaatttcaggactttccctccatgtggtggccactcctggagaaatgatgcttgtgcgtgactaataaaaggcaggcttcccacagacacacttttcttgctaagagcctattccttcaggctgttgtattttgttaacagtgacaatgacaagcactaacaggatgctcccgctgtgattgagaatgtgatcttgtcgcctggttctgatggtgtcttggttcccggctggggttttgtgtttaccacgagcgttgcctgctgtcggggagctgcgtgtgtttcacaacaaacagggagccagggagaccaccctgcggggctgccccttccctcagcgctttctgcttgggtcgctggcgtcttgcagtgccttcgttcgtctgtggtgtgaggtgctggtccaggcttacgcgctaacagtgaattagaaggagaaaacgctctgcgagtgcagcggaaggtcaatatggagcctggtttgcttttagaatcttcccaaggccgatgggcttcctcttccctcctgaccagaggctttgatgcccctgccctgggctgcctggttcctgccccgagtcttcagaaagatccccgggcctggagactgtgagttcaggttcagatgccttgcgtggcctgtgaatcctgggtctggtctctgtccccaggccggtgttcagggaccaccttgagcaccaaaggcagcccagtccggctttgactcagctcccagggcggagtcccttgcccagcactgggcaggaggagggcatcctcagggcaaggtctgccatcagcagaccagagccagagcccgcagcccctgagcactttcagattcctgcagcgcagagaggttttccgggagggaagggaggaccctgtggctggagaaatcccgccgcgaacacccagcgaccaggtctacagcagcaccaggtctgtgcttccccctggtggtcacagattttactacacgcggcccacaagtaaaatgagtttctcttcagtggcccggttatcttctgtcgtgtaggaggaagtccagagccacggaaattcggtaaggatcggataagggcaataaaatcgcagctctaaatcttttcatggagttgaagacagacgtttgactgtgggagccatctcatctttataacctggtaaacaatgccagaataaaaacaacaaattcaatgtatttaagtcggtttcgacagtgaggaattaaaattaaatttatttaaactattttgacttttacccaagtttttcttacagttccatctcatttttccctccttacatagtttggggagtagagaacagtctatttttgactcctgtgtaactgacatggacacagaggcctgcggtcccttggaggattagtggcccacgcaggtgtgcagaccacgggtccctcaatcagaagcgggatgtgtggcagggagctttggagagctttcattttggattagtgatttcctgtcgacttttcctcgtttttgtcacagcacactcggaacatttctcatcagctgtgtacactatgtcaggcatttcaaatatgtttctggaagttgtcagtgctgttctctatgaggcctgaaggaaaaattcaatgtttgtagtaaataaagtacaaaaattatatcagctattaagaggatggattatttccaagttgcttagccatattggttgagcgttgaatgcagcaatgatgccaacatattaagcacaagaa

SEQ ID NO: 466026 - DNA, 3820 bp, Homo sapiens
  misc_feature (1)..(1): n is a, c, g, or t
  misc_feature (4)..(5): n is a, c, g, or t
  misc_feature (12)..(12): n is a, c, g, or t
  misc_feature (14)..(14): n is a, c, g, or t
  misc_feature (16)..(16): n is a, c, g, or t
ntcnnttttttntnanagagatcaggaggaacaggccgaacgggacaaacgggataaaaaaagaaggccaccactttagtcatggccctcagtcaagcggactttggaggctctggaaaagggaaagcctgggcaaatctaatgcttaatagggcttgcttccagtggtgcctggggcaagcgccagcccatgccatcaccttcacggagccctgggtatgcttgaccactgagggccaggaggttaactgtctcctggacactggtgcagccttctcagtcttaccttcttgtcctggacaactgttctccagatctgtcactatccgaggggtcctaggacaggcagtcactagatacttctcccaggagagacgttctagcaaaagcaggggccattatacacctgaacataggagaaggaacacagtagaatggacacctgaagcagaagcggctttccaggccctaaagaagagcctaacccaagccccagtgttaagcttgccagtggggcaagacttttctttatatgtcacagaaaaaacaggaatagctctaggagtccttacacaggtcctagggaccagcttgcaacctgtggcatatctgagtaaggaaattgatgtagtggcaaagagttggcctcattgtttatgggtagtggcagcagtagcagtcttagtatctgaagccattaaaataatacagggaagagatcttatcgtgtggacatctcatgatgtgaacggcatactcactgctaaaggagacttgtggctgtcagacaaccatttacttaaatatcaggctctattacttgaaggaccagtgctgcgactgcacacctgtgcaactcttaacccagtcacatttcttccagacaatgaagaaaagacagaacgtaactgtcaacaagtaattgctcaaacctacgctactcgaggggaccttctagaggttcccttgactgatccctacctcaacttgtatactgatggaagttcctttgtagaaaaaggacttcgaaaggcagagtatgcagtggtgagtgacaatggaatacttgaaagtaatcccctcactccaggaaccagtgctcagctggcagaactaatagccctcactcaggcactagaattaggagaaggaaaaagggtaaatatatatacagactctaagtatgcttacctagtcctccatgcccaagcagcaatatggagagaaagggaattcctaacttccgagggaacacctatcaaacatcaggaagccattaggagattactattagctgtacagaaacctaaagaggtggcagtcttacactgccagggtcatgagaaaggaaaggaaagggaaataggagggaaccgccaagcagatattgaagccaaaagagccgcaaggcgggaccctccattagaaatgcttatagaaggacccctagtatggggcattgatagcacccatcagatggccaaatcattatttactggaccaggccttttcaaaactatcaagcagatagtaagggcctgtgaaatgtgccaaagaaataaccccctgccttatcaccaagctccttcaggagaacaaagaacaggccattacccaggagaagactggcaactagattttacccacatgcgcaaatctcagggatttcagtatctactagtctgggtacatactttcactggttgggcagaggccttcccttgtaggacagaaaaggcccaagagtcccacatgaaccctcctgagctgaagcaaaggacccagacctgtctgtggagctacttgagccccaaaatgctgcatcccaactgtatccctggtctgtcctggtctccctcttgggccaccctggttgctcctgtcgtgtgggcctggctccaggctgcacacctggctcatcaatgccgaacaagctctgccagctgctgcatgattgttgacactcggcgtgcactggctgtttgaccacatcccggaacactctttgctgaaaccgacaaagtaaaatattcctgaacatataatgtagtactctggggggaaaattaaacattttagtggtatattaaaaatagtaaataaaatttcagaaaatttcagaatatatcacattgcctagtgcaatgacctaatagaccagggagctagcaaacaagaaaccagtattgcaaaagtgaaatgattttcattgtaaacatataaaatgcagttactgtgaacaaatataatccccaaacaataacacttttgttatcagaactctgttaagtaatcaagaacttataaaacaatgatttttttgaaaatgccccctttggagaatacaagcatgccctgtatcggcatagcacttttaaacactttcatgtctctgatcttattatagccttaggatgcatgtgaaactcatgttttcgtagacaaagaggttccctttataagaagcacatctgggactctaatttcaggactttccctccatgtggtggccactcctggagaaatgatgcttgtgcgtgactaataaaaggcaggcttcccacagacacacttttcttgctaagagcctattccttcaggctgttgtattttgttaacagtgacaatgacaagcactaacaggatgctcccgctgtgattgagaatgtgatcttgtcgcctggttctgatggtgtcttggttcccggctggggttttgtgtttaccacgagcgttgcctgctgtcggggagctgcgtgtgtttcacaacaaacagggagccagggagaccaccctgcggggctgccccttccctcagcgctttctgcttgggtcgctggcgtcttgcagtgccttcgttcgtctgtggtgtgaggtgctggtccaggcttacgcgctaacagtgaattagaaggagaaaacgctctgcgagtgcagcggaagggaggaccctgtggctggagaaatcccgccgcgaacacccagcgaccaggtctacagcagcaccaggtctgtgcttccccctggtggtcacagattttactacacgcggcccacaagtaaaatgagtttctcttcagtggcccggttatcttctgtcgtgtaggaggaagtccagagccacggaaattcggtaaggatcggataagggcaataaaatcgcagctctaaatcttttcatggagttgaagacagacgtttgactgtgggagccatctcatctttataacctggtaaacaatgccagaataaaaacaacaaattcaatgtatttaagtcggtttcgacagtgaggaattaaaattaaatttatttaaactattttgacttttacccaagtttttcttacagttccatctcatttttccctccttacatagtttggggagtagagaacagtctatttttgactcctgtgtaactgacatggacacagaggcctgcggtcccttggaggattagtggcccacgcaggtgtgcagaccacgggtccctcaatcagaagcgggatgtgtggcagggagctttggagagctttcattttggattagtgatttcctgtcgacttttcctcgtttttgtcacagcacactcggaacatttctcatcagctgtgtacactatgtcaggcatttcaaatatgtttctggaagttgtcagtgctgttctctatgaggcctgaaggaaaaattcaatgtttgtagtaaataaagtacaaaaattatatcagctattaagaggatggattatttccaagttgcttagccatattggttgagcgttgaatgcagcaatgatgccaacatattaagcacaagaa

SEQ ID NO: 466027 - DNA, 433 bp, Homo sapiens
tctgagatccaggtagaaagaccaaaaggaaaattaagaacagactctcagacctgccttccctttgcattcaggttggtttcctttttacaactgcccaagtcatgagttcatagggcctggatggctgtaccggattgctctccagctggtctctctgcatccagaaatttctacaacctactggggtaaaatctttctcaaccctgcttttcatcatcacatcttaaatatctcgagttggttccctattgccaaaaaaaatccattgtccatgtagggttcttctgccgaaacgaggaaagagtgagttaaatgttggtaggtgatatagagatagtaattaggcaatataattcgatgttgttgaaagagctgagctatgaaatgcattgtgataaaggggctgcctgtgtaagtaaatgggtataat

SEQ ID NO: 466028 - DNA, 3766 bp, Homo sapiens
ctatcgtgacgctccatgctgtgatgggcagatgtcccaggctagccaaagaactccatcccctgggcctaatgactgattcagccaaggatgcagaatatgatcagaaatctggggccataagaagctggagcagcaaaacacattcacagtgcagccagcccttggctcccagaattcccaaaacaagtgtgctcccttcagaaatacagtccttggaaaagaatttatgccgacaactcatgcgcttaattgaaaatatgctcatagacctcctcgtactttttgagtcacaaaacatcagcaggctctctcatacagaaggaggagaaaacagagtgaaggatctaaaacctgaaaagaggccaaatgattcctcaaaaccacgcaagtacgaagtagcagagcggatctcaaatccaggtctccagtgtcagaaacgctgagtatcactaatctcaagaccttctctctgctatacgagctctggcagagcttgtctccaagggctagacaggaaaaaaaaaatctgggttcaattaaaatatatcaataaagagaactaaaaggagctccaaaacgttgctgcccttctgcgggctgtctgtgtgtaatgccggctccttcactcttttatggcaccatgattgtgttttaccctcccgactgttaactgccaactgttaactgttaactgcccaaggttgccctgctgatgtcatgcctgaccatatgacttgctccagccaatgaaatgtaagcagaagtgacatatgcagcatgacccgtggaagcttcgaagagctattgccaatttccaccctctctctggaaactgtcattagggttagggaaactgtcatgagatctgcatattttagatagaggctgcttgccttatttgggcacctaatgaaaaagacatggaggccaggtgcggtggctcatgtctgtaatcccagcactttgggaggccaaggcgagtggatcacctgaggtcaggagttcgagaccagcctgaccaacatggcaaaaccccgtctgtactaaaagtgcaaacacaaagggaactgcgtggcttgtttctacctgaacattgtcaagtgatttcatcctttgaaacacagttgtgaagtgtgtccagcagtctgagaacaagaagaagaagaaaatctaatccttcagggtgtctgtgtgccagccctgctctcagcacttcccatgtggaactcctttacttctcctaacaactccatgacatgggttagactgtgattgttcccatattgttggtagggaaactgaggcatgcaggtgttacagagctctctcaagtggcaagctttctgggtggttacagagtggcagagctggggtatcccatgatgtcaccacactgctatatggaaaagaacattaatcgagcacctacgtgcttgattctcttaattctgtgactgaactctcaaaacaccctgggttggtttcctttttacaactgcccaagtcatgagttcatagggcctggatggctgtaccggattgctctccagctggtctctctgcatccagaaatttctacaacctactggggtaaaatctttctcaaccctgcttttcatcatcacatcttaaatatctcgagttggttccctattgccaaaaaaaatccattgtccatgtagggttcttctgccgaaacgaggaaagagtgagttaaatgttggtaggtgatatagagatagtaattaggcaatataattcgatgttgttgaaagagctgagctatgaaatgcattgtgataaaggggctgcctgtgtaagtaaatgggtataatgaggtgtaaaactccctttctctctctctttctgcttcataagcctttctgcttctcaagtccagacctgctgtttttggggtttccttccaatttttttgctgcttccctggggccttggctcttgggcctgctgcctcttcccactctacacctttggattccttatctttggctccaccttattgctccattctccaaagacaaatccacaaggcataggattttacagaatatggggttacagaaacagcatagggaagtgtaaaagcctagaagcttcttacagacgcagccccttgtctgtagctcctgactcccacttaaatgtctgttggaagcaccctggggtagcagaacccagctcagaagatggggcttatccaccatgccttttcctaacctgacacccacccagataatcttttcaatatgcaaactagagcgtatcaccccctgctcagagcctttctgtgacctcccattttgcttcccaggactccttgctccttagccaggtctccaggtcctccgtgatcaggtctctgctcttctgcagcctcatctctgccattcttcaccttttgtgctccaacccaatctggttttcttctcatgctttgaacaccccaagtctgtctgcttcaggagcttcgtactggctaatcattcaccacagcatactcccatctatacggctggctcttatattatgggtctcagctaaaatgtcatcccttcaaagagaccttcttggaccacccccgccattctctatcctatttctctcttttattttctttgaagcacttacccactttcagaaactatctggcttgctcatgtgtttgtctctagattgtctacttcccctcctagactgtactctccacaagagagcaaagctgtgtctgttgcattcactgttgtcttcccagaagcaagcagcatgctggagaccctcaaatacatgtgaaatgaagggacaccttgtgttatttcacctgtttccacctggttcccaagtggcaagcttgcattgaggttacaaagtggcaaagctgggatatcacatgatgtcaccatgatgctatatgaaatgtaacattaattgagtacctatgtgaccagttctttaattctgtaagtgaactctcaaaaaaccctagagcactgcgtgttttgaaatatacaaatagtgggaaacgaaatctttgttctggatgcagttataatttggaaagcgaggaaataaattataacaaggggaaaaaacagacacagagggattgaaatgcataacaatagagatgaaacacgaagagtgataaatgaagattgagtgtgcacaccttctggaggagccctgattgagtattttaaaatactactaaagtcatgccgtgtgacttctgaagctagctcctaagaagtccttgcagcttctgcctgcgactcttagaacacttgctttgaaggatgccagatgctgtcttaaaagtctgagcactctgaaaccatcatgctgtgaggaagcccaagctaaccacatgggcaaaaaagatgccctctgactgccaccatttgagacactctaattaagaactgcctcattgagcccatgaggccctgtgaatgataataataaattgtttttaaccactatgtttttggatttgttataagtttatagataacaagaaaaagttatattagcatggtaataaaattatggatatgtgtaagtttggtgttttgtttcttttttttttttacactaagcctatattactgttgtaatttaggaaatcacttgttttcctccagcacttcaatgtaagagtggcactacttagaatgtacttcttaagatatggctgtacatagaacaaattattcaccatgatttccttagcatccaacagaat

SEQ ID NO: 466029 - DNA, 965 bp, Homo sapiens
tattccatgtgtcagtgaagggatgtggggttatggccacctacgtggccacctatgcaagatgacagtttcgctcatagttgagccgtccttgaagaacacccacgttcctcctgttgtttcttctggagtgcggaggcttcgctggggccgcgggcggcagctgacgggcgggcccttccggaggcgccgcgcctggaccgtggccgcaggttgggcagcgccagacgcagagccctgtgccgcttgcgtccccgggcttcctgcccgacaaggacggggggccggacagagagccgtgtcggccgagacccgaatccgggatcaggtttgtgtttctgtggacactgaggtggccacagcggcgctttctctacccaaacctcgcttcctctcgctgaaggggttccagtctcgatcatcagtgaagtccttccacatccatggggcgtccaccaactaggagcttaatcaacacaacgctgtggcctctccagctcagggacgtgcctttcccgtgtcttcttctcacacacaaacgtagcctgcaaggaagacttaagaggccaattaaaaataaaggtcacggcgcatggtgaggagttgctgttcgtaaccgacggaaaaggcttcatacgtgaacacggctggacaagcaaccagaacaggtgcttccccaggatgtccagaaacaagcagagaccgtgaaggacatttaacctcaccaccaattccatgtgtgcccatgaaaacaagattccattgttggctgacagattggcaaagattaatactagccaatgttagcaaagacatgaaaaaatgggccgttacggttcctgcttacttattaaacatttctgtgggccagtttggcaatttgaactgagcgtaactcttttgtactcaaggaactttactgctgatagcctcctgttaaccagaagcctaagcaataatacagt

SEQ ID NO: 466030 - DNA, 2792 bp, Homo sapiens
ctactttcctcctcacttctccagacatcctgctctttcaaccaccgttcctttgctcatgctattccttaggcctggaacagctgaaaaactctgattgtccctaattggatgacattccagaacactctcattagaaggatgcaggactctgattggccaggctcaagtctcaggcccacccctgaggaggaaatgcattctgcttttctaaatcctgactgtgtcaccctccacagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaaaactgagtccaggaacacctgccttgttcagtgaagccgctgcccatctaaagaagctggaactggaaactgtgaaggctgctggaccctggcctcctctgcacatcaacataaacaaggctgaagaaaagaaagtctcggagaaaactcttcagactccacttttgccttcccctgttgcggatcatgtgaagtgtaacattctgaaagcccagttggaaaatgcttcccgagtgaacatccagggtggaaaggaggaatcaccgtttgtaaatatcaataagaaatccagtcttcaggacgctagtgtaagaagtcctattcctattcgtgtggaaactgcccagccagctgtggaaaagccggaaatcaagcctccccgaagtattggatcctgcaagctggacatctggtggacatctgtttgggaacccccaatccccatccctggtcttcccacccctgcccatcctccgtccactcctcacagcctgtttattattgtaatgagcagagcttcatgtgcttttagtaaccgcagtgatgaagacgacctccctccagacctggccgaggcagtgggagtgaccacatctacaaccacaaacaccacaacggccgccacacaagtctccgtgccgctgccgtcccccaaggtccagaatgtcagctcgcctcacaagtcagaaggcaaaggcctgctgtcccctggggccaagagcccctctgaccgaggaggtgcctttaccctggagccgggtgatcttctgatggatttcacagaagccactcctctggcagagcccgccagcaacccccactgtgcccactctcgctgttctcctccactctctctccccatgaaggaagagaccactggagtttgcatgtaccctccaatcaaaacgaggctgataaaaacattcccggttgatacaatgaacccgtttcctgatactttcaccacagggccacagtttactgcagacttcagagacagtaaattacagtgctgtcctggcccgacttccccgctgatcccagcagcgaccctgaggcctttgacagagaccgtctccacagtgcagaccatttacaccacccggaaacctgtttctctggcagccagtgcagagacactccggcaggaactggagagagagaagatgatgaaaagactgttgatgaccgaactgtgaaattctccccttgtcacctggaagatggcatggtgccttctgtccgtcttctttcttcgggctttgtgtgctcactctagcacagcatacaagtgtgtgctctgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatcttttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaagattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctactctcaccaatttaaatgtctttatatccatgttacatgggtaacctcacttcaccccattattagatatttgagttatatctaatttttcactcttataaatagtgctgctatgaatgtctgt

SEQ ID NO: 466031 - DNA, 1176 bp, Homo sapiens
tcttttgttcccatggcagttttgtcttctttcagaagactgtgctccccatcatgcccaccagcgccgtgctgttccccgctgcacttcttgtgctgctttttgaatttgctccttcctcccagtttctgcagttcagcaactcaggctctggcagttctcctaatggcagcagcaacagcccttctcttacctcctggcttccagcattgcccccttggaagtgtgtcttccacttgcggctggatcccggagctccgctccttgtccagagggcagctcccagcccttctcagatggccgggctgctcttggccggggttgagcggtcctgcgccagctccttcagtgtggaggctttcagggagcacgggggagatcagctctgcctgtcggcccgccctgagctgaccacaagggtgtttgcaaaggaagggtgggggcctactcaatgtgaagacaataaggatgaagacctgtaagatgctccacttccactcagtcaatagtcaatatattttgttttccttatgattttcttaataatgttttcttttctcttgcttattttaccgcaagaatatcgtatttaatacatataaaatacaaaatatgttttaattggctgtttatgttattgtaatccaaataaatgttttcttttgtcattgaaacggagaccctaacagagcaagaggcctgaccttcacacctatgtaacccaaggtcacagaaatgctgaggggccatgtgactccagtgaagcaggagtatccatccagccacagagatgggacctgtccaaatgggacctgtctgttccaaaggttattctgcttgaaaatcaggccaggcatggtggctcacaactgtaatcccagcactataggaggccaaggcagatggatggcttgagcctaggagtttgagaccagcctgggcagaatagtgagaccctatttctacaaaaaatacagaaaaatcagccaggcttggtggcatgctcctgtagtccgagctactcggaaagctgaggtgggagagtcacttcagcctgggagatcaagactgcagtgagcagtgatgaaactactgcactccagcctgggtttcagagcaagtccctgtctcagaaagaaaaaaaaaagaaaaaagaaaacaagtcagtattttccc

SEQ ID NO: 466032 - DNA, 2798 bp, Homo sapiens
cccatgcacacttcacaggcacgtgcacacctcacccaccctatgcacacctcacagacccagcacacttcacaggcacgtgcacacatcacagaccgagcacatgtcacagacccatgcacaccccacagacccagcacgtgtcacagacccatgcacacctctcagacccatgcacacctcacagatccagcatactccataagcacatgcacacatcacagacccagacccagcacatgtcacagacccgtgcacacctcacagacccagcacatgtcacagacccgtgcacacctcacagatccagcacatgtcacagacccgtgcacacctcacagatccagcacacgtcacagacccatgcacacctcacagatccagcacatgtcacagacccatgcacacctcacagacccgtgcacacctcacagatacagtacacatcacaggcacgtgcacacctcacagacccatgcacacctcacagacccgtgcacacctcacagacctgtgcacacatcacagacccagcacacttcataggcacgtgcacacctcacagacccagcacatgtcacagacccatgcacacctcacagacccgtacacacctcacagacccagcacgtcacagacctatgcacacctcacagatccagcacacttcataggcacgtgcacacctcacagacccatgcacacctcacagacccgtgcacacctcacagacctgtgcacacatcacagacccagcacacttcataggcacgtgcacacctcacagacccgtgcacacctcacagacccagcacatgtcacagacccatgcacacctcacagacccgtacacacctcacagacccagcacgtcacagacctatgcacacctcacagatccagcacacttcataggcacgtgcacacctcacagacccatgcacacctcacagacccgtgcacacctcacagacctgtgcacacatcacagacccagcacacttcataggcacgtgcacacctcacagacccgtgcacacctcacagacccagcacatgtcacagacccatgcacacctcacagacccgtacacacctcacagacccagcacgtcacagacctatgcacacctcacagatccagcacacttcataggcacgtgcacacctcacagacccatgcacacctcacagacccgtgcacacctcacagatccagcacacttcataggcacgtgcacacctcacagacccatgcacacctcacagacccgtgcacacctcacagatccagcacacttcataggcacgtgcacacctcacagacccatgcacacctcacagacccgtgcacacctcacagatccagcacacttcataggcacgtgcacacctcacagacccatgcacacctcacagacccgtgcacacctcacagatccagcacacctcataggcacgtgcacacctcacagacccgtgcacacctcacagacccgtgcacacctcacagacccagcacacttcataggcacatgcacacctcatagacacattcacacctcacagacccagcacacttcataggcatgtgcacacctcacagacccgtacacacctcacagacccagcacgtcacagacctatgcacacctcacagatccagcacacttcataggcacgtgcacacctcacagacccatgcacatctcacagacccgtgcacacctcacagacccagcacacttcataggcacatgcacacctcatagacacattcacacctcacagacccagcacacttcataggcacgtgcacacctcacagacccagcacacttcataggcacgtgcacacattataggcacgtgcacacctcacagacccatgcacacctcacagacccgtgcacacctcacagacccagcacacttcataggcacgtgcacacatcataggcacgtgcacacctcacagacccatgcacatctcacagacccgtgcacacctcacagacccagcacacttcataggcacatgcacacctcatagacacattcacacctcacagacccagcacacgtcacaggcacgtgcacacttcacagacccagcgcacatcacaggcacgtgcactcactcacatctcacagcatcatcttacatgacggcttcaatcacaggccgccctgcaacgtcaaacaagcatgaaggctgctcccagggtttcgtttgttctattaatgctgaaagtggttaactttcagaaattgactgcactgtcttcttttcatttccccatagattggggaaacattcagcacatactgagtttggaaaccattctccagaaagcctccaaatgcatctggacaggaaggacagtgacagccaattcatttcccatcaaccttcctatcctttcttcttacctaagatctccacttctgcgcagcgtccagtccatcctttcacatggttggaaaaacaagctgaaattaggaccattttttcaaaaaagcaacaataaaaagaaaacacgcaagttggttttctgcccctctggaaactcaggctcaactacgactattctctatttgcttcaggcgcttcaggaaggaaagctgagtccacaacccagggttacgttctgtgcacatcctggtctgtctgccatctcgtgagctccctctcgtgctccccgagctatagacatttgtcagcttagggtggttcggtgtcaggaaggctcctgccaaatgcaacatgggtgtggaaacacagcataggatgggcc

SEQ ID NO: 466033 - DNA, 776 bp, Homo sapiens
ctccaagcaggagccgccgagtgattgatgggccccagcttgaatggaaagtccagattccagcaacacagcttaagagatgaaggttgcttgagcaggaaatccacccatggcccaaagaggaaagatccgctttaaatgcctgggcatatacttccaagaaccagatgtggcctgttccttacacctccctgggcttagatgacagcttgaactctgcggctgatggaattgagcagatgggaatgacctggaatctaacactctacaattcagacacaccactgtccacttgtccctcccttcctgccactggccctgccagcgtaccttgtgtacttcgcaaaggtcactggctcctgttttatgtaatgactgacagacgatctcgcccagctcagcaatgtgaacagacaccttgcatggtgccggtggtgggtgcggttgtttctggatgtcatggaagaggctggggcataccagggctttccccaattgtgcctaaaataaattggctcttgggaggtttctgtgtgcctctgacggttctcgaaaccaactttcttacctatgggaaaacacatcctggtgaagcaaaggtcgtggagggcaccgagtctccttcccggagtgaatagggcctttctcagcataatcaggaggggccctcaaaccaggtggttttctgggcgttggaacagctcaatgccgaggccacaggtgctctctcaaggctacctgttgacggaatgaggaaacctgcaaaaagagtggcc

SEQ ID NO: 466034 - DNA, 3347 bp, Homo sapiens
caggcagtaacaggggttgtctctgggtgggtccctgtctgcattataatcacctgttcatattcaaattaagcacattccatgcacaggcaattcaagtacatgcgtgttgggaagcaccggtggcctcacccaaggctccgcatttgggtgtttgtgtatttcccccctccctgccttgcatgatcggggccactgcactgtcggtcagtatggggcggccctcacactacgccagccagtgcaggtccctggacaaggtgggccccactgggagttgacggacggcagaacatgacggagatgcgcaggaatggcaaagtacgaggggaaaacagacagtgggatatggtgaaaccgtgacggttggtgaatgagactttgatccaatgacattaaagcagatgagccacccaaaactaatatacagtgtctactgcagaagacgtgtgctcttcaccagtctgtggaccaggaaacgagccgctggggatctcagtcgcaagggtgctcaggtggccttggtgcagacactcacagctctcagactgcagagtgtgccggtcctcggagaaggggtgtccttcagggcagtgcttctctggctgatgccacagactggctagtggatggccagactcatcacactgacacccctgttcacctaaaccagatacaaccccttcctgatgcatctgttggtgccaaatcttttttttttttttgtagctttttattattaaaacagtcactgcaattatcaggagtcgtctaatgtacagtgactgctattcctattgctggtgagtgagaatattaataccatctgtagtagtgagacagcaaatatttcccgcctcacaggtgccctggtattttagtgcagaaaatattcttacagttccctggaaagcacgctttataaactcttacacattttcaaaataaagattttttaaaataaacctttttgtctctgacggattttaagtctcataacatgagacgtcagccttgctgcgatacgcagcaccacaccagaagcctccagcaagcgctgtgttctgctgtggttctgagcagcctcgtagtgccatgcagtgctcttcagacatacgctggggctcagggctgtgggcctcagagcacagggagggggcaggtccccatggggaggagcagctgcccctgcacctgcatctaactgacatggatgttggctccccacactgtgagcacctgggtgtttctggctcctttactgctgaaatttaggacagacccaatcgacttagagagctgtctcaggactccttgacaaaccaaatggaggaaggaggggaacagctggcaggccacgtatccctgcaccatagaaaggagggcccaggacaccctggaggacagacacctcctggtaaactcaacaggaaaatccacctcccgggacgcatccccttctcctcgctgccctccctgctgggaagaccctgtcctcaggcggtccatgcgccctggaacgtgggcgtggggacacgggtggtgcagagctgccactggcctagcctcctggcgaaggggcaagctggttcgtggggaccacccgaaggcctggagggatttgggctgaagcccaggccgctcagcgggagtgtgtgctgtggagtccctggtgcagaggctgatgctgaccgtcctgagttcgtggacgagtccacgggtcctgccagcacacctcagcatcgccggtgtttcagcaaagaatccaaagaagaacaggaccatcgcgagccactttccgcctcttcatccccgtccactgaggaaatccaccgaagccctttcacgggaccacggctgtgccatctgggtgagctgggctggcaggtaccccgaaaagcacacagggaatccacaggaaatccacctcagccagggacatatgcacaccccccacatcctgaaggcaactgcagctctcagagaccgagaaacacacaccacaccgcccccaccatggagatcggtggcctcgttcttccggtagcttccaaactcctgtttgatcatgatggtctgtctcttgtgtggcctgacacggttgcccagaggcacgaggaaacagtcgccctgaggcagggcgtgggccgtctgcacacgacggagaatgaaagagaattcaaggagagcggtacagctgggactcggggagttagcgtacttcaaacccaattctgtgatctgagccttctgaggcatccgcagcgccgtctcggcactggcaggggagggcaggggcggccgaggtggcagcgagtcctcgggaactgtgggtgggacctggtgttccccacagtggcagctccactcagggccaggcagcagtcccgccgtcacagcgccctcgggaggctcggtggccttgaagccagctgcccccagaggaggggtgccctgtgctccaggtggggacagagctggggtgagagaacccagactcagaataggatcgttctcgtgatcgtcaagggctgccacgtgcggaatgaggagtggtctcctgctgtgggcaggcctgggggcctcctccaccccgaccttcaggaaccccagattctggtgaaagggcaccgctgcgagagggaggcgggcgccggtcatgggaagggcggggggggtgcagcgaagcagacacattttccctggaggactggggctggcgggaagcgtctctcaactccattccctcatcttcgcagcaggggccggcgtgccgcctcttcagtggttctgtcagtgacacagatgcattgtgtcaaagtgaaaattgctctgggcaaagctcgactggcaaggaggactccaattaaagcttgcgtgggggagacaggcccgaactcagccagagctcagctccccttgaacgaaggacgagagggcttctcagagctggagagagaggggacgctgtgcatttacagcctcattcataactcccaagcccagcacgtgcctgtggagcaggcggaattccaaaagtccaggcacaccctgctgggggccgcagaggacagtgggatcgttgtcacctcccctctagagctgctttcaccattctaaaacatcaggaaaggcatagctcacatgttgctaagaaaaagcattttggaaggtaattgtggttgctatgcatggaaactatgctacgtcttagttttgtaacaaagagtgtttaatgcgtgtctcatttaaaacggttccctattgcagcacgtccttcactgcagttcagaaaatcactctgttgtgtatttacggtgtatttggattaaatatcaagattgtat

SEQ ID NO: 466035 - DNA, 519 bp, Homo sapiens
actctctaattaccaccgctacaggactagtgacacaatagtcctttcccaaaaggagcacctcccagtcactcagattgtgatgacagacgcaggccaaccacattccgaagcagattatacactggggccactgctctgctgcggagatacaagacttctgaaagtatggagaagagaaagtgtgatttttgaaatattcccttctctttttgggagactgagatgggaggatggcttgagccaaggagttcaacacaagcccggacaagatgagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaagctttaactcaacaaaatgg

SEQ ID NO: 466036 - DNA, 989 bp, Homo sapiens
aaatggttatgttttgcaagttcgccagccagcctggggaaagacgggtccttagctgtgtactcagcagtgggagacagcggccagaggctgagatccaaccctgctcaaggcagaggtgggtcatggtattcaggccaggcctccagaaggtcacactacctcttggtgacactctgtgtcaggtgctgaaatgcaaacctttggacactgactcaacatctggagatattttttctggttcttttggctggtgttctcctacagctctctacgagcagtcttgtgaagcccacaagcaccgagggaacccatccgggctttactatattgatgcagatggaagtggccccctgggaccatttcttgtgtactgcaatatgacagactccgcgtggacggtggtgcggcacggtggccccgacgcggtgaccctccgaggtgcccccagtgggcacccgcgctcggctgtgtccttcgcgtacgcagcgggcgcggggcagctgcgggccgcggtgaacctggcggagcgctgagggcagcggctggctctgctctgcgggacagcgcggcgcccggactcacaagatggaaccccactgagctggtgtgttggaagaaccaatgaaacacacacttactggggaggttctctgcctgatgctcaaaagtgtacttgtggattagaggggaactgcattgattctcagtattactgcaactgtgatgctggccggaatgaatgagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaagctttaactcaacaaaatgg

SEQ ID NO: 466037 - DNA, 832 bp, Homo sapiens
aaatggttatgttttgcaagttcgccagccagcctggggaaagacgggtccttagctgtgtactcagcagtgggagacagcggccagaggctgagatccaaccctgctcaaggcagaggtgggtcatggtattcaggccaggcctccagaaggtcacactacctcttggtgacactctgtgtcaggtgctgaaatgcaaacctttggacactgactcaacatctggagatattttttctggttcttttggctggtgttctcctacagctctctacgagcagtcttgtgaagcccacaagcaccgagggaacccatccgggctttactatattgatgcagatggaagtggccccctgggaccatttcttgtgtactgcaatatgacagactccgcgtggacggtggtgcggcacggtggccccgacgcggtgaccctccgaggtgcccccagtgggcacccgcgctcggctgtgtccttcgcgtacgcagcgggcgcggggcagctgcgggccgcggtgaacctggcggagcgctgagggcagcggctggctctgctctgcgggacagcgcggcgcccggactcacaagagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaagctttaactcaacaaaatgg

SEQ ID NO: 466038 - DNA, 491 bp, Homo sapiens
acatccaacctttgaatgtattttgactaggtaatttttttctcctttgttaataaaaatagatttaattttttaaatgtcattttttttgcatctcatcaaatatactgtcatacactataaaaatgatgttgggtcatatgtatcacatgtctgtaattcagaaatgcaaacctttggacactgactcaacatctggagatattttttctggttcttttggctggtgttctcctacagctctctacgagcagtcttgtgaagcccacaagcaccgagggaacccatccgggctttactatattgatgcagatggaagtggccccctgggaccatttcttgtgtactgcaatatgacaggtatgttgataatcgttagatgcatagatcagaatagaccaaggagaaatttacctagttggcagcattattaaaacatgcagtttgatagtgtgtacttgctaagtagaagcattaaatatgtatttatt

SEQ ID NO: 466039 - DNA, 2021 bp, Homo sapiens
aaatggttatgttttgcaagttcgccagccagcctggggaaagacgggtccttagctgtgtactcagcagtgggagacagcggccagaggctgagatccaaccctgctcaaggcagaggtgggtcatggtattcaggccaggcctccagaaggtcacactacctcttggtgacactctgtgtcaggtgctgaaatgcaaacctttggacactgactcaacatctggagatattttttctggttcttttggctggtgttctcctacagctctctacgagcagtcttgtgaagcccacaagcaccgagggaacccatccgggctttactatattgatgcagatggaagtggccccctgggaccatttcttgtgtactgcaatatgacagatgctcagggtcaccgcctggaaagtgctgttagaagctcaaggcctctgattcctctgggcttggtcactgatggagaagctgacataattaaaccactttattttaatagagctgcttcctatcatacctgtgagtctgctttgcctcttgctgctggcctctgccgcccagtgatgcctctcctttgcccgtttctgctcagcagactccgcgtggacggtggtgcggcacggtggccccgacgcggtgaccctccgaggtgcccccagtgggcacccgcgctcggctgtgtccttcgcgtacgcagcgggcgcggggcagctgcgggccgcggtgaacctggcggagcgctgagggcagcggctggctctgctctgcgggacagcgcggcgcccggactcacaaggactagtgacacaatagtcctttcccaaaaggagcacctcccagtcactcagattgtgatgacagacgcaggccaaccacattccgaagcagattatacactggggccactgctctgctgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacaggctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattgtgtttccgttgtaggtggaacggccaccagacagagaggctttctaggatgcattcggtctctgcagttgaatggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatggtaagtgtgaccaaggagcaggttatagggaaagtacatgaaacttaaatagtatgaagaatgcttctggcatttgatattataaagagaggataagattgaattatttgaaatggaataatttctgtaccaaattcctctattgaatttagaagggatatgactgtttttgaaaacttaaggctatcagtcctctctgggtttcttatttagaagatctctgggttaccccagcatctgttcaatgctaatcctctcgaaataatttggttttcaaaactctgtccttgtactgttctaattttaacatcagtaaagcatcattcttatttttgtttttaatttttagagacaacgtattgctattcaagcctctctgttgcccaggccggacttgaactcctaggcttgagcaatcgtctt

SEQ ID NO: 466040 - DNA, 1325 bp, Homo sapiens
aaatggttatgttttgcaagttcgccagccagcctggggaaagacgggtccttagctgtgtactcagcagtgggagacagcggccagaggctgagatccaaccctgctcaaggcagaggtgggtcatggtattcaggccaggcctccagaaggtcacactacctcttggtgacactctgtgtcaggtgctgaaatgcaaacctttggacactgactcaacatctggagatattttttctggttcttttggctggtgttctcctacagctctctacgagcagtcttgtgaagcccacaagcaccgagggaacccatccgggctttactatattgatgcagatggaagtggccccctgggaccatttcttgtgtactgcaatatgacagatgctcagggtcaccgcctggaaagtgctgttagaagctcaaggcctctgattcctctgggcttggtcactgatggagaagctgacataattaaaccactttattttaatagagctgcttcctatcatacctgtgagtctgctttgcctcttgctgctggcctctgccgcccagtgatgcctctcctttgcccgtttctgctcagcagactccgcgtggacggtggtgcggcacggtggccccgacgcggtgaccctccgaggtgcccccagtgggcacccgcgctcggctgtgtccttcgcgtacgcagcgggcgcggggcagctgcgggccgcggtgaacctggcggagcgctgagggcagcggctggctctgctctgcgggacagcgcggcgcccggactcacaagatggaaccccactgagctggtgtgttggaagaaccaatgaaacacacacttactggggaggttctctgcctgatgctcaaaagtgtacttgtggattagaggggaactgcattgattctcagtattactgcaactgtgatgctggccggaatgaatggactagtgacacaatagtcctttcccaaaaggagcacctcccagtcactcagattgtgatgacagacgcaggccaaccacattccgaagcagattatacactggggccactgctctgctgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaagctttaactcaacaaaatgg

SEQ ID NO: 466041 - DNA, 1498 bp, Homo sapiens
aggcctggttcatctggctggtggcccaccagtggaatggattccctggatcctctcacgaccatggaccctctaagatccctgcatgcagtattgtgggctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccaccccgtggagaagcgctttgtgcatgaagcagagaagttcaggccctgtgaaatcccctttgaaagccttaccactcaaaaacaatcctaccggggcctgatgggggagcctgccaagagcttgaaacctctagccaggcctcctgggctagacatgcctttctgtaacaccactgagtttcgagataagtaccaagcttggccaatgccccggatgttctccaaagctcccatcacctacgtccctcccgaagacaggatggatcttctgacaacagtgcaggcccattacacatgccctaagggtgccccagctcagtcctgccgacctgcacttcagattaagaagtgcggtcgctttgaaggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaatagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttgactcagggaaaatgacatttaatcaccggctaattaactccccttaccttctcctttactgcatccccaccccgtttcaggtcctttactttgtgcttatggaatcaaagttggtctgtgaggttttctctgatccagatgtattttattaatttaatcattgtatgaactgacataatgattaacccttgccaagtatgaagcgccaaagaataaattttattttggggggaatg

SEQ ID NO: 466042 - DNA, 1266 bp, Homo sapiens
atctctgtagccatcactgagaaatctggattttcaagggcctttctctctgttgcccaggctggagtttagcgactcaatcatggctcactgactgcagcatcgacctccggggctcaagtgatcctttcatctcagcctcctcagtagctgagactacagacatggataaaagaaatccctgtaaaaggcagcttaactggatgtttccctccaatggcaaagtgactctcaatgggccaagagatctcattatgttacccaggctggtctcaaactcctgggctcaagcaatccttctaccttggcctctcaaagtgctgcagttacagatgtgagccactgtgcctggcctgatgttaatttataatgctttcctatgaataaactgttaaaacactttagtcaatgtatccaaatctgattggtggcctaaaactgaaccaataaaagataattgcaaatatatttcttattgaaatctccctttcccccaaaggttaagaggattgaggacatttctgaaaaaggaggagtagatagtcaaaatctaggtggaggttgtgtatttgctgattgatgcatttcagaccataatggagaagaccactttgttcattaacaaacgtttccatatcagtgcctgccttttgtggctcatgctgtccatccctgacattttctgccccctctttctttctctcaccccccttgttgtgtactaaatcctttctgcctttaagtgtcactccaaaaccagcttcctgcatgaagccttctcagattcccccttctcccagtttggcttgttctcccacaacaatgctctgatgcactatcttattttaccttcatgaatttctacaacatgcatctgtctccttcactaaattataagctccttgagggcaggactgctcttcttttactgtgtgtccctccttcgttactgaacaatctttatacatctcttgggcaaacacatatatcttaaatctgattgtttacattgctcatgagtataattgttaaatataattgtgtgataaatgtaccaggaagtggatcccctggtctaattgccttgcgaagtattctttcttctctctggggtgaaataagtcaattatattgaaagttagaattgttaaaaagtttataactagtaagggtgattagaagccctaaattcagcaaatgttcagcaaagtatttggtgtttactaggtatctagtatcatgctagtgatgaactaaatagtcact

SEQ ID NO: 466043 - DNA, 1757 bp, Homo sapiens
aacagctgctcacagctcaacttggggatttcaggccacagaatgggggtggttctgtggcagcttaacttcagggatgaagaggcacccatagctccatgcccctggagcaagacacactccaacatagttccagttccaaaatggcataacacagtagccatgcaggccactggggaagctctcgggcctgcatggtgtttacacacacacaaaaataatggcttctcttcagttctacctgcaggtgtcacagtaacagctcttattattcatggcaagaagtactggaatggtggtgtcccaataaggtgccatgttcagagagtggtgaaagctaaagctgaccttataagacctgggaaaaatgagtacgcatcctgtctgagagcaataatatcatgctgtacatacagtaaagtcaggggtttcctctgggaagaggcacataactccaagaaactcaagagggaaatcagggtgacatttataggatactgacctcgtacagacagggtcctttcatgcataactattagcttcattatgtaagagccacctagagtgtagaagagcaataagattaaaagatattgttgttttaattttcactttgcatggtcactttacgttgtccacacaacttattaaagacatggataaaagaaatccctgtaaaaggcagcttaactggatgtttccctccaatggcaaagtgactctcaatgggccaagagatctcattatgttacccaggctggtctcaaactcctgggctcaagcaatccttctaccttggcctctcaaagtgctgcagttacagatgtgagccactgtgcctggcctgatgttaatttataatgctttcctatgaataaactgttaaaacactttagtcaatgtatccaaatctgattggtggcctaaaactgaaccaataaaagataattgcaaatatatttcttattgaaatctccctttcccccaaaggttaagaggattgaggacatttctgaaaaaggaggagtagatagtcaaaatctaggtggaggttgtgtatttgctgattgatgcatttcagaccataatggagaagaccactttgttcattaacaaacgtttccatatcagtgcctgccttttgtggctcatgctgtccatccctgacattttctgccccctctttctttctctcaccccccttgttgtgtactaaatcctttctgcctttaagtgtcactccaaaaccagcttcctgcatgaagccttctcagattcccccttctcccagtttggcttgttctcccacaacaatgctctgatgcactatcttattttaccttcatgaatttctacaacatgcatctgtctccttcactaaattataagctccttgagggcaggactgctcttcttttactgtgtgtccctccttcgttactgaacaatctttatacatctcttgggcaaacacatatatcttaaatctgattgtttacattgctcatgagtataattgttaaatataattgtgtgataaatgtaccaggaagtggatcccctggtctaattgccttgcgaagtattctttcttctctctggggtgaaataagtcaattatattgaaagttagaattgttaaaaagtttataactagtaagggtgattagaagccctaaattcagcaaatgttcagcaaagtatttggtgtttactaggtatctagtatcatgctagtgatgaactaaatagtcact

SEQ ID NO: 466044 - DNA, 3579 bp, Homo sapiens
gctgcgccgcagctccctctagtggcactcttgatttagctaaaggaaacgtggagcatcccattggccatcctccccactctccaattcggctccagaggcccctccagactataggcagctgcccctttaagcgtcgctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttggtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacggaagcaaaggagggcgagcgggccgtcgttcctcacccaaggacccaaggtgcgccaccggaaagcgctgcggtgtcccgaggactctcgcctcgcctgcgcctctgcactggggctgccaaggttccaggaagaggcaggactgcccggcccagccttggaggaagacttctgggcagaagcggaacacaggagcagagacacatagtcttggctccagtttcgtttcagttatgcccaccctttcagtgttcatggatgtgcccctcgcccacaagctagagggcagcttgttaaagacctacaaacaagatgattacccgaacaagatattcttagcctatagaggcaccttcccacagccccatggagtccaggagagatttgtttgcaggctgtctgcagagctcagccctgggggcccaaaccaggcatctggagctccctctgtggttttcctcacagtctgcatgacaaatgaaggccatccctgggtttctctcgtggtgcagaagactcgactacagatttcacaggatccctccctgaattatgagtacttgcccaccatgggcctgaaatcattcatccaggcctctctagcactcctctttggaaagcacagccaagccattgtggagaacagggtagggggtgtacacactgttggtgacagtggtgccttccagcttggcgtccagtttctcagagcttggcataaggatgctcgtatagtttacatcatctcttctcaaaaagcagatcccacatggctgtgtccttgtgatggggaacattatcgactgcaagttgacaccaagtgggtgggcaaagttgatgtccatgataaagagcaagcagatattcccattttttgatattccctgtcaaggtttatacaccagtgacttggaagaagatactagaatcttacaatactttgtgtctcaaggctttgagttcttctgcagccagtctctgtccaaaaattttggcatttatgatgaaggagtggggatgctagtggtggtggcagtcaacaaccagcagctgctgtgtgtcctctcccagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactgtaagggtctagggggctggtgtcccccctttctgacctttggcctgtatttgagcattaaacttcactgactaggtgaccagttcctagcttcactccagattttgattctgtcctctggaaaatgggctgctttaaagacacttctggacccccagaagtaccgacactccctatccttcataaaccagcctgggtgcccggtgcagtggctcatgcctgtaatcccaacactttgagaggccgaggcgggtgggtcacctgaggtcaggagttcgagaccagcctggccaacatggtgaaaccccgtctctactaaaaaataaaatatgaaaattagccgtgcatggtggtgcatcctgtaatcatagctacttgggaggttgaggcaggagaatcgcttgaacctgggaggcgaaggttgcagtgagccaagattgcaccattgaactccagcctgggcaacaagagcaaaactccatctcaatcaatcaatcaataaaaaaataagaaaataaaccagcctgggctagaggagaattcgagatggccagtctcgagatctgagaccttgtcatgattttagcccagcaggtggaatacctggtcaggaagaagcacatctatatccccaagaacggtcagattaacttcagctgtatcaatgccaacaacataaattacatcactgagggcatcaatgaggctgtcctcctcacagagagctcagagatgtgtcttccaaaggaaaaaaaaacactgattggaataaaactttagtctttgcaaaaatcttgtgctgattattcatt

SEQ ID NO: 466045 - DNA, 3572 bp, Homo sapiens
gctgcgccgcagctccctctagtggcactcttgatttagctaaaggaaacgtggagcatcccattggccatcctccccactctccaattcggctccagaggcccctccagactataggcagctgcccctttaagcgtcgctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttggtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacggaagcaaaggagggcgagcgggccgtcgttcctcacccaaggacccaaggtgcgccaccggaaagcgctgcggtgtcccgaggactctcgcctcgcctgcgcctctgcactggggctgccaaggttccaggaagaggcaggactgcccggcccagccttggaggaagacttctgggcagaagcggaacacaggagcagagacacatagtcttggctccagtttcgtttcagttatgcccaccctttcagtgttcatggatgtgcccctcgcccacaagctagagggcagcttgttaaagacctacaaacaagatgattacccgaacaagatattcttagcctatagagtctgcatgacaaatgaaggccatccctgggtttctctcgtggtgcagaagactcgactacagatttcacaggatccctccctgaattatgagtacttgcccaccatgggcctgaaatcattcatccaggcctctctagcactcctctttggaaagcacagccaagccattgtggagaacagggtagggggtgtacacactgttggtgacagtggtgccttccagcttggcgtccagtttctcagagcttggcataaggatgctcgtatagtttacatcatctcttctcaaaaagaactgcatggactcgtcttccaggacatgggctttacagtttatgaatactctgtctgggaccccaagaagctatgcatggaccccgacatactcctcaatgtggtggagcagatcccacatggctgtgtccttgtgatggggaacattatcgactgcaagttgacaccaagtgggtgggcaaagttgatgtccatgataaagagcaagcagatattcccattttttgatattccctgtcaaggtttatacaccagtgacttggaagaagatactagaatcttacaatactttgtgtctcaaggctttgagttcttctgcagccagtctctgtccaaaaattttggcatttatgatgaaggagtggggatgctagtggtggtggcagtcaacaaccagcagctgctgtgtgtcctctcccagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactgtaagggtctagggggctggtgtcccccctttctgacctttggcctgtatttgagcattaaacttcactgactaggtgaccagttcctagcttcactccagattttgattctgtcctctggaaaatgggctgctttaaagacacttctggacccccagaagtaccgacactccctatccttcataaaccagcctgggtgcccggtgcagtggctcatgcctgtaatcccaacactttgagaggccgaggcgggtgggtcacctgaggtcaggagttcgagaccagcctggccaacatggtgaaaccccgtctctactaaaaaataaaatatgaaaattagccgtgcatggtggtgcatcctgtaatcatagctacttgggaggttgaggcaggagaatcgcttgaacctgggaggcgaaggttgcagtgagccaagattgcaccattgaactccagcctgggcaacaagagcaaaactccatctcaatcaatcaatcaataaaaaaataagaaaataaaccagcctgggctagaggagaattcgagatggccagtctcgagatctgagaccttgtcatgattttagcccagcaggtggaatacctggtcaggaagaagcacatctatatccccaagaacggtcagattaacttcagctgtatcaatgccaacaacataaattacatcactgagggcatcaatgaggctgtcctcctcacagagagctcagagatgtgtcttccaaaggaaaaaaaaacactgattggaataaaactttagtctttgcaaaaatcttgtgctgattattcatt

SEQ ID NO: 466046 - DNA, 2270 bp, Homo sapiens
gctgcgccgcagctccctctagtggcactcttgatttagctaaaggaaacgtggagcatcccattggccatcctccccactctccaattcggctccagaggcccctccagactataggcagctgcccctttaagcgtcgctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttggtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacggaagcaaaggagggcgagcgggccgtcgttcctcacccaaggacccaaggtgcgccaccggaaagcgctgcggtgtcccgaggactctcgcctcgcctgcgcctctgcactggggctgccaaggttccaggaagaggcaggactgcccggcccagccttggaggaagacttctgggcagaagcggaacacaggagcagagacacatagtcttggctccagtttcgtttcagttatgcccaccctttcagtgttcatggatgtgcccctcgcccacaagctagagggcagcttgttaaagacctacaaacaagatgattacccgaacaagatattcttagcctatagagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactcccagcaggtggaatacctggtcaggaagaagcacatctatatccccaagaacggtcagattaacttcagctgtatcaatgccaacaacataaattacatcactgagggcatcaatgaggctgtcctcctcacagagagctcagagatgtgtcttccaaaggaaaaaaaaacactgattggaataaaactttagtctttgcaaaaatcttgtgctgattattcatt

SEQ ID NO: 466047 - DNA, 961 bp, Homo sapiens
ctttgcctgtgccttgcctacctgcgtgtgcatccactgtcatctggaccattcctcccccagaatcttccataatctttataggcctggctggattcatctctgacccttctctgccacctgatcttctagccagcatcagacgcaacttggtcatcttttcttaaatacgaccagctagtgggacagatgttgagtcactgtctgggaaaatagggcctaggggcatctgtgaaagttcatcacgtttcagtggggctttctgctggctttcacagaagaatgcaccaatagtgcaggcccagccacagatcagaaccacagagagcctggaaaagtgtcagtttcatatggttcaatctaatatttgaagcatttgcattaaagtcaacagcaagatcaagatggtttttattgctattatgttacattgctttccaggatataaaggcacttatgaaattaataaatcaatgaatgaatttatccatttaaacatcatctatggagtatctggtactggccagacaccggaatggtcttgtaatgcagatacaaacaggtataaccagctagaagtggagatgcctttgggggaagcacgtgactcagggtgcatagctggtgcacatgcgcatattgcaactaaaagcttaggttttggattcaatcaggaagggaagcaaaatgctagctgtggggatcccccaccccaaatgagggttgccggtcggggggtggtggtgaataatggggtctatcatacagtgaatgatgacgatgaaaataatgacaacatttgcatgattcgacatggctgcttctatacaggagggattgaggaaagcaatttggctggaagtggctgctaagagactcttctggaaacttcccttgcacagcatgcactgttcttacctatagtatgcatttgttcatttagggaagctgggggaaatgt

SEQ ID NO: 466048 - DNA, 2584 bp, Homo sapiens
tctgcagcttcactcctgaagtcaggaagcaagtagaaacgggctttttttgggggaggagacatttgcagcccattggacggattccccgccgccctcctcccagaaggtccccactccccgccccgggccctcccccggcttccgcgctgggccgggagcctgggtgggcggggtagcctctctagccttgccttcttggctggaggcacaaaggcattaacttagcgcccggggtctctgccaggctcacgggacagctgcacctctcagcgtctccagctccaggacgcggtcgtcccaactccttccgagtggaaagagtgtaaaacttttgtccgtgcgcgggtggagctcagtaggaccacggcgcgtcctgccccggcttccccagcctcccagcagggttagctgcggtcagcgcactttccacttgggactcccggccagaaatttctcgggaatggagcggtcacagtgtggcagcagagaccgaggcgttagcggccgacctcacttggcccctgggctagtggtggctgcccctccgcccccgtccccggcgttgccggtaccatcggggatgcaggttcccccagcgttcctgcggccgcccagcctctttctgcgagcagcggccgcggccgccgccgccgctgccgccacctcgggaagcggaggctgcccgccggctcccgggctggagagcggggtaggcgcggtgggctgcggctacccgcggacgcccaagtgcgcccgctgtcgtaaccatggtgtggtgtcagcgctcaagggccacaagcgcttctgccgctggcgggactgcgcgtgtgccaagtgcaccctgatcgccgagcgccagcgcgtcatggccgcccaggtggcgctgcgcaggcagcaggcgcaggaggagagcgaagcccgggggctacagaggctcctgtgctcggggctctcctggccccccggtggtcgggcatccgggggcggcggcagagccgagaatccacagtccacgggcggccctgcggcgggggctgcgctgggactgggtgccttgagacaggccagtggttccgcgacccccgctttcgaagttttccagcaagattatcctgaggaaaaacaagaacaaaaagagagtaaatgtgagtcatgccagaatggacaagaagaactgatctccaaatcccatcagctttacctaggatcatcttctaggtctaatggtgtcattgggaaacaaagtatcgggtcatctatttcagaatactccaacaagcctgatagtatcctgtctcctcatcctggagagcaatcaggaggtgaagagagtcccaggtccttatcatcctctgatctggaatcaggaaatgaaagtgaatgggtcaaagacttgactgcgaccaaggcaagccttccgacagtgtcctcaagaccaagagatcctcttgatatccttactaagattttcccaaattacaggcgcagccggctagaaggcattctacggttctgcaaaggggatgtggtccaagccattgaacaggttttaaatggcaaagaacacaagccagacaacaggaacctagcaaactcagaagaactggaaaacacagcctttcagagagcttcaagttttagtcttgctggaattggttttggaactctagctgcagatctggtggagtttgctggaggtccactccagacactttttgcctgggtatcatcagcagaggctgcagaacagcaaagactgctgcctgttctttcctctggaagcttcattccagaggggcacctgccagatgccagccggagctttccttcaggactctcagctgtaggtcttttggagtttgctggaggtccactccagaccctgtttacctgggtatcagcagcggaggctgcagaacagcaaatattagtgaatagcaagcaagtgctgctgcctgatcgttcctctggaagttttgtctcagaggagtacccggccgtgaataccatttacaaagacaaagtatacagacagaatggccatgccgctaacattctccattctgattaacgggctgtctgaagctgcctctatatattcactaatcaaactaattttttgagactacagcatgaatgtctccaaggcagtatggtacttctctacaactttttaaagttatttagaatttaaggttctaagaattaaacaaagaatataaatccactgtttctcattgtatgcattatcgatgcccctttaaaggactgtttttcatgctgaagaatatgggtttctgtaagttatgtaagtaatgagttagcctttctatacattaaaagctgatgcttttaaaattctgcccctttagcattttctgaatatgtagaagctttttgcagtggttggatttatttaaacatattatacacttattaatcatttgtgttgctgggtttaatgtagattgtttctattttggctgttcaattttaaaacacctagtttataaatggagagaccaagtgagcttgaaatggctttgtttcttcatgctgtgtaaggaagttctgtgatgcc

SEQ ID NO: 466049 - DNA, 1192 bp, Homo sapiens
cgccctgctcaccactattaatcttgacttcccttccttgtctgttttggcatcactgtataacccgatatgtatatgcgtgtgcctgcgtgtatgcgtgtgtgtttggggaggtgggtaaagattcaaacttttcgaagtatcaatctagaaattgagtcaggggtctgcatctcatttattattagaaattcagttggaaagcaaaagatgattcaaaaaacaagaccctcaacagcagcttatcaatctggatgtaattttgactctgccaagataatgaaggctaaactgaactgtgagatgagacattctactccattccatcccatttttggaaagatgaggggtaaaatggcaatagcacctgtgcaaacactgagtgatgtttccagaggattgtcaattaggttattttctacctttaatcacatgtactgcgtttttactgagcgggaagcccagaagcaaaagggtagggggaactgtgttagttcgtcccttgcaaactatctccatctgctccgtgctacttaatctgttctaaatgagggaggaacaatgtattatctttattttattgatgaagaaacaaaggcatacagtaattaaataacacctgagatcacacagtcagtcagtcctagaggtgcaattccaaaccagctctaatgggctaagagtttatactcctccctctgctatggggacaatgtggtaatgtaatctactttaagccaaaaggtgctccttggacaatttagaaggtatattgctttaaggtaaaatcttaactgtatatttacttatacagctagtgtttgtgctgttgtttttatcagtatattgacagaaaccgttgaatctgaaggaaaaaaagtgaaaacaaaacaagacatgtttgatgctgtgggaagaaagtattagaagtgaaacctaatcgttcatgacatagaaggcataaacgaagcagcaaactgaggaactgggggaattggggaaaaggtgagcactatgtgcattctcactgatctggcttttccatggttcagggtgtctaataaaatgaatacatgctcagaatgctgcccccctgcctttctttcttgggtccataaatgactctagtgaggtgggaggtaggctcttcattgtttctacttggagccactgactttaaagttttaataaa

SEQ ID NO: 466050 - DNA, 935 bp, Homo sapiens
tatatgtaggaacaaaaaagaaaatcttggccaggtgtggtggctgaggcctggaatcccagcatcttggaagacagagattggcggatcacctgagaagctcagaggatccagaacagcagcctgtcctcgctgggctgttcctgtccatgtgcctggtcacggtgctggggaacctgctcatcatcctggccgtcagccctgactcccacctccacacccccatgtacctcttcctctccaacctgtccttgcctgacatcggtttcacctccagcatggtccccaagatgattgtggacatctaatctcacagcagactcatctcctaggcaggctgcctgactcccatgtctctctttgccatttttggaggcatggaagagagacatgctcctgagtgtgatccctatgacccgtttgtagccatctgtcaccctctatatcattcagccatcatgaacccgtgtttctgtggctttctagttttgttgtcttttttttctcagtctcttttagacgcccaggtgcacaacttgattgccttacaaatgacctgcttcaaggatgtggaaattcctaatttcttctgggaaccttctcaactcccccatcttgcatgttgcgacaccttcaccaataacataatcatgtattcccctgctgccatatttggttttcttcccatctcggggacccttttctcttactataagattgtttcctccattctgagggtttcatcatcagtgatgtacacggtggtcacccccatgccgaaccccttcatctacagcctgagaaacagggatattaaaagtgtcctgcggcggccgcacggcagcacagtctaatgtcaatatctccttatctgttccatgccttttgtagagtaatacctccctaggatatagaacatactgtcatagagtata

SEQ ID NO: 466051 - DNA, 1296 bp, Homo sapiens
tccctacccaattccccttagcctgctatgtggagatacaggaggcttgcacccgccgcggtcccggtgtattttaacgggctcccggggaagcggtgggttcggcctggaggagcggcgtgggggcgccggggccctgattccatcctgggcgggtcggccccgcagccgctgcgctcggaaccccctaggcgccccgcagtacccggcgtccttcctgcctcctcctcgcccctgtcctccgtccgagccccagtcccgccgaccctgccggcgcctccgccctcccgccctcccgccctcggtttcccacgacctcggcgcgacgcgcgcgggatccagtggagactgctttcccataggccgccatccagggcggggaagggagcggaccctcccggctccaggtgcctgggcccccggcggcctgcggaggcctcgccccacgccacccgcccactggcctcgtcttcgcgcggggagaaaagcagcctgattcggaggaacgggttgcttggggcggctcccagctcgagttgtgggccccgccgcgggtgcccttcggaaacgcgctgacaccaggcgaagccgcctctgcccggacgcagcccgacacttggcccgcggggttccccgggacgcctgagagtaatgggcgcgagggggaaagccgaacggcctccctgtgcccggcgcaggcggtgccccctagctgggttcgccgcggcggcgctgcgagcccccgacactgaggacttttggtccaacagtccgacggggcccggtgcgccgttccctccgccctctccccgctccccggcccgcgcgtcttggagggtgggtgaattgtcggaagcactctacgcctggccaacccaaaccaggaacctccgcaccaaacagcccacgttgctgctgctctggggttttaacggccaagggagactggagaaggggtgttctgccttcccattctcttaggcccgtccactccccatccccacagtttggaagtggccttttctgaggactccagcgcaaagcatgtttctccttttgagctgcggaagccttgcttgttcccgccattgggagggcattccatcatctgcagctgccttcctcggtgggccttgtcccttagcgtccacctaggggacattctaagcttcttgagacctgcttgtccaccccaacatgtctcagcatatggctgtgccctaaggggtctttgagggcattttaggagaaaggtgcctttcttcccccttcacgtgaactgcctccatgattgta

SEQ ID NO: 466052 - DNA, 1129 bp, Homo sapiens
aggaaacgtctgaatggcgtcttcttccaataggaggctgtttgatctacactgaaaatccgttatttggtgtagccacctttatctgtcatcttaatgactttatgtctcaactatccttagtattccatgttgaccctaaatgtcaatttatttatcttttgggaaacagtgataactttagacacttggttgcatgtggtgtgtgtgcatcagcagctgtggcaaaccccgaccctgcccgccaccaggagcatggacccctggccagatgctgccgggcaccttattcaggaagtcagcccagcagctgtaggagggcaggagctggtgctcagccccatcccagtggctgcacagtgcccagtgccaggatccctcgctttgggcgcttgtccaggaggaagaagggggtggtgcagtcaagcgggccctggggcaggcctggcccagcgctccgttcttgggagccctgccagcccacaggcccatctgcggcaggcacgtggtgccgcgagaacttggctcagggacggtttttccgccatgcgcagattctcgcctctcgcgggggcgccagggggcagctggttgaggtgcgcatgcgcactggcacctaacggctcttcttcgagtcttctcagaggttggagattccctgtcttctccaacctctgccaagtcttcagagaggttggagtgcgcctgtcggaggtactagaccccagatgaggatctcaggaagatccacaaagctgcgtccaggggaacgaacgtgtggaagctgcagcggagcctcctgctcaagagtaaaggaccggtctgaaacctacaagaacagattctcacactagacgaggagcctgtttttcagctagctgctgcaagggagctggaaatttctcccttcagataggacctagaaggtctgaaagcatctggagaagggtgcggctgggagtagagaaacaggctacagactgaagcaggaggaagcgagagaggaagactcatggaaagccttgttgcgctcgccaaaagagctgccctcgcactcgagagggccatgtttaatgcctacctgaagaaaggtagtaacctctggagcacttgtggcttggggtgaaaa

SEQ ID NO: 466053 - DNA, 3237 bp, Homo sapiens
tctggtttattcagaggatagaggaggcttttggaaattctgctttccagtgaagaaatcttcaggtgtagagaactggttgtcaaacttgagcatgaatcagaagctcctgagggtttctgaaaacacagattactgggtcccctgccagagtttcctattcaaaccaggtccactttcagggctccatgggggctcttcaatgatagttactttaaaaatgctagacttccttcttgttaaaggcaaagacataaaggctgaaccacctggaactgggggtgtggtgatgcaagcacttctcttgccaccaccactgggaccgtgctgggtcagacctgaagccggcctagtactaggtcttgccgaaggcccttcctttcagtgtgagaagcctttccctgtggccaccaccagcagtaatctaagatttccagagaacttttttgcgcagctctctcctctatggtcctctgttctgaaacctctagccactaaggtctcccccgatccttagctctgtcttctcaacttaaagaggaagtttcctgggctccaactggatttttgcttcttgctctgtggccttgaaattctctcaaggcaatcagacaagatatgtaggtttttctattaactctatatcatatctttttttttttgtgactgaagattagccttaaggacagacttggccttgatatgctaaatggagcatgaagaaatttggaaaaattctttctcaagaaaataatctggtttgcgagatattcttattgcacaaaccaagctcatgtcaagagctgaatattacctcctctttctctttgcataccttctgctttaattactaagcttccctcagacaaatagatactgaggacagatttagagtaaaagtcttatactcagaaagttattaaagcacacagtcatcatagaaattaggccattctgcttgacaagagtagcaaaggcttcctatcttgtcatgggtaagttccttggttggccgatctggctgaatttgtttattctctctggaaggatctaccggagtccctcttcccctccccttctggctctcccctccgatgttgcttggtaaagatgctcttcctagggctacacagcattcaaaaccaacttgctattggtgtgcttttagtaaccagggactattttaggggtttactaatcatagagaatctggggacagtcttagggagaagaaacttccttggaaatatatttccctttaaacttagaacagttttgctttatttgctcctggtaaagtccgcatttaaaaataacagtcagctgggcgcatgttgaaatgaacaagtgtttgagtcaacctccacagaaatgtttgaaagattaaaaatattttattggccgcacaatattgcaaggaagacagcaacattgaaattacaagtgtttaattaaatgtctctggattgtgacattaggtcaactagttgagggcaactccattcaactcatgtatatattacatttaatgtggaatgagagcattttaatatgtgtaataaaagataagagtctccaaaagtaagagtgcatagagcctatgaactatcaaaataaccttgtctacactccgtgatggttcttatcacaatgatcattatctctgtacctcacaggtggattctgaatggtgggtcaatgtccataggaaatggctccagttgtctatactgttttctaagcatctggacctgaaccctaaataagaatgtaaaatgaaatactgtattcctcattctatttcttcaaagtttatattgtgttaattttaaaaaagcaaagtttaaaaacttattttccatattaagttatttatatcaaaatgcagagttcaggttctttattgtaaagttggtgtttggtccttagattttcaggccacagaagcccagttctacccacaaataaagataagtttttataaacagtacataattgcattttcttttgttttcaatcgaatttgcacattttgctttcaaattgagtttttgatccttttatattcaatgtaattactgatatatttgagttaaatttatcatcttattttgtgctacttatcccaactgttctatttggatttttttatcattccaatttttgtctgtactatcttcacagttgtaatttttcaattttttaaagtaatttaactacaagtaacaacatgtttttttgtttttgtttttgttttttgccttatcaaacttcagtgttaattgaaaacccttccattgctcgctggcttcctttgttactattgagaagtcagttctcagtctaactgttcttcctttgaaagtaactgcttcttttctgatgctttaagatttttgtctctgtctattgttgtctgaagttttgctgcaatgtctgggtgtgagtttcttataatttattttgcttaggatatatggagattcttaaagttgtagattgatatcgtttttacttttgaaaaattcagagctgttatttcttccaattttatatctgtcccattcccttcacactttctgggctacaacttgtcactgaccacttatgcctcttatccactcttttccaattcttcccttttatttctgtgtgctgcattctggaggatgttttcttcttgtcttccatttaaaaatgttagctacatttcatttgctcttaagcccatcttaattttgagtattatatttttggatttttttcttaatatgtcacattaaattttagagtttccttttcacggatgtttttaagcttggaatttatttcataaatgtaaaaagcatcgttattttgtgaaccatatctgatcatttcaataattcatgttttggaggctttttttgtagcttctctgtcttctgttactcattcagtgatcttgttgccttgtaaacccttatttttcattgtatgatggaaattatattttataagtcatatggaggaagtgctgaggcctgttatgatgatgtctttctcttgagaggatattcatttgctgctgcaaatagcagtgtgtgttatcattccagaaatatcttaatataatgtcagagttgaagtttacttgtactgttaaatgatgcaaaactgactacaattctgtgccagggctggtttcctagcagctactcctcatattgagagtgtggcctttcagattctcagctc

SEQ ID NO: 466054 - DNA, 1146 bp, Homo sapiens
ctaatcagttcattaaagagatgaggtgaaaataaaccacatgtacacgcacaccagataaactgaatgcttccttctgctggggacacgctgtaggtgagcaagtgcaccaaggacaaggcggccactgatgaaaaggaagggaaaagagacttcatttccatacccactaaccatgccaacagaaggctttgtgaagaaggaagtaaaagctatcggtaggagttagaaagaaacatttctagttacaagaacagcagaaaaagacctgaacttcagagtggaccacaaatgaatatgaattaataacacagatctcttttcaaaagccaacacaaaatgaggatgtgttttttgcaaaagcagttgttcttgccactgggcttatgcttgtcattctttcatgtgtcacagccagacctaggaaattccctggaaagtcccctccatcacacacctgcagtttttccatttgagtgtaattctgttggaccttgaaagactttttgatctttgggacgctcttatcaccaaatgtatctttctgcaggaagaagacagaagaaaggggtggactatgagatgggagcctgggtcccaatttcagttcaaccattaccaaccaggtggctttaggcaagtctggtcatttcctttgcctcagtggctttctataaaatggaattctatagggatgatgaaagcgaaaacgttagccactatgcttgctagtgctcaagaaatgattccttcctgcctgcctgcctcagttttccatctgtaaacaaggattcaactagaacatctttgaggttccttgagctctaacactctgtgattctgttggcagcaccttaagaaatttacaacaaacactccattgagtcttaatctattagatcccattcagttctaatagtgttgtgattttgactttgtagcctcatgtttattttctctcttcctgattttttatttatatattctatttaatagtttttgctttttcaagttgtcaccagttctttgtagaataagaaaaaagtataactaactggaggaaagaatgcattcacagaaagccaaggaatgataacactaatgctaatacaatactactgctaataaaaataactgcctttattg

SEQ ID NO: 466055 - DNA, 1112 bp, Homo sapiens
ctaatcagttcattaaagagatgaggtgaaaataaaccacatgtacacgcacaccagataaactgaatgcttccttctgctggggacacgctgtagatgaaaaggaagggaaaagagacttcatttccatacccactaaccatgccaacagaaggctttgtgaagaaggaagtaaaagctatcggtaggagttagaaagaaacatttctagttacaagaacagcagaaaaagacctgaacttcagagtggaccacaaatgaatatgaattaataacacagatctcttttcaaaagccaacacaaaatgaggatgtgttttttgcaaaagcagttgttcttgccactgggcttatgcttgtcattctttcatgtgtcacagccagacctaggaaattccctggaaagtcccctccatcacacacctgcagtttttccatttgagtgtaattctgttggaccttgaaagactttttgatctttgggacgctcttatcaccaaatgtatctttctgcaggaagaagacagaagaaaggggtggactatgagatgggagcctgggtcccaatttcagttcaaccattaccaaccaggtggctttaggcaagtctggtcatttcctttgcctcagtggctttctataaaatggaattctatagggatgatgaaagcgaaaacgttagccactatgcttgctagtgctcaagaaatgattccttcctgcctgcctgcctcagttttccatctgtaaacaaggattcaactagaacatctttgaggttccttgagctctaacactctgtgattctgttggcagcaccttaagaaatttacaacaaacactccattgagtcttaatctattagatcccattcagttctaatagtgttgtgattttgactttgtagcctcatgtttattttctctcttcctgattttttatttatatattctatttaatagtttttgctttttcaagttgtcaccagttctttgtagaataagaaaaaagtataactaactggaggaaagaatgcattcacagaaagccaaggaatgataacactaatgctaatacaatactactgctaataaaaataactgcctttattg

SEQ ID NO: 466056 - DNA, 1879 bp, Homo sapiens
taatccttctgcgttagcttttggcaaatgaaacatgatattcctggatccactcaggcacagtggacacggcatcagagagattggctgcagcccccttgcctgttaccctgcagtgacagcaggtatgctgcaggtatgctgcaggtatcctcgccggcgtgcacaagtcacctccccgtccagatgtgtttgtgagcatgaagattctccacacgggggcctgttcctttgcctggttctcagaggaggagataatgaatttcagtggtacttctgcataaagagggactttgcaaggtgtatttcaggagttaccgattcagaaactggagaagcagaacacaaagagaccttggtcttctctctgaaggctagtggctggacctgcactcagatggcaattcaggtccagttcatgagatcttggactgttttgacaaatgatttggggaaagggatagggagagagttgtcagtaccgatgctgagactgtgagagccatttctgagtggaggtgaggaaaaacggagcgatgaccgtgagggtctttgcgtggcgcctcgagaccacacctgggaacggtgactttggaactggctgacgtgtttatttggtgtgaggtcaactacagctctgagggcaataacatgatcctcataaaacagaccccccaggctgggcctcagcccgcttgctgccaagcaggggtggtggcctaataagtgagacattgctatcaactctctgtaaatggtgggttcattcactctgtggatgacatagcctgttctttgcccttctgtgtcagccccattgattgctttttaaccaccttcttgctttgtgctgcttctttcagatgaaaaggaagggaaaagagacttcatttccatacccactaaccatgccaacagaaggctttgtgaagaaggaagtaaaagctatcggtaggagttagaaagaaacatttctagttacaagaacagcagaaaaagacctgaacttcagagtggaccacaaatgaatatgaattaataacacagatctcttttcaaaagccaacacaaaatgaggatgtgttttttgcaaaagcagttgttcttgccactgggcttatgcttgtcattctttcatgtgtcacagccagacctaggaaattccctggaaagtcccctccatcacacacctgcagtttttccatttgagtgtaattctgttggaccttgaaagactttttgatctttgggacgctcttatcaccaaatgtatctttctgcaggaagaagacagaagaaaggggtggactatgagatgggagcctgggtcccaatttcagttcaaccattaccaaccaggtggctttaggcaagtctggtcatttcctttgcctcagtggctttctataaaatggaattctatagggatgatgaaagcgaaaacgttagccactatgcttgctagtgctcaagaaatgattccttcctgcctgcctgcctcagttttccatctgtaaacaaggattcaactagaacatctttgaggttccttgagctctaacactctgtgattctgttggcagcaccttaagaaatttacaacaaacactccattgagtcttaatctattagatcccattcagttctaatagtgttgtgattttgactttgtagcctcatgtttattttctctcttcctgattttttatttatatattctatttaatagtttttgctttttcaagttgtcaccagttctttgtagaataagaaaaaagtataactaactggaggaaagaatgcattcacagaaagccaaggaatgataacactaatgctaatacaatactactgctaataaaaataactgcctttattg

SEQ ID NO: 466057 - DNA, 2908 bp, Homo sapiens
ggcgtcccactccttctcttcatcctcctccagctcctcctccacgtcttcctccagctcctgctcctctttcttttccagtacctcctcagccccttctcctctgccagcccctcctcccacctccgctcccagcccctcctcctttcccagcccctcaccatccagcccctcctcctccatctcctcctcctctctcagctcctcctcctcccccagctcctcctcctgctcctccttctcctccactcctccttctgctcctccttctcgttcagctcctcctctcccagcccctcctcctcctccagcccctcctcctcatccagccctttctcctctcccagcccctcctctcccagctcctcctcctcctccagcccctcctcctctcccagcccctcctccccagctcctcctccaacagcccctcctcctcctcgcgcagaccctcaccatccagcccctcctccttcagcccctcctccagcccttcctccttcagcccctcctccagcccctcctcctccagcccctcctcctcctccagcccctcctcctccagcccttcctccttcagcccctcctcctccagcccctcctcctcctccagcccctcctcctcatccagcccctcctcctcatccagccctttctcctctcccagcccctcctctcccagctcctcctcctcctccagcccctcctcctctcccagcccctcctccccagctcctcctcctccagcccctcctcctcctcgcgcagaccctcaccatccagcccctcctccttcagcccctcctccagcccttcctccttcagcccctcctcctcctccagcccctcctcctccagcccttcctccttcagcccttcctccttcagcccctcctcctccagcccctcctcctcctccagcccctcctcctccagcccctcctcctccagcccctcctcctcctcttccagttcctattcggggcgggcccagcccctcctcgcggagcgatcgatggcttgggctcgtcgcacacgcctgcccagcctctgcgctcggctcgccaggcctgcggcgctgccatggagacacggcccagcggccgccggccccgccctgggagccccgcagtgcgtcgcgccgctgcccgcatctccgaggcccgcgacgagcggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggaccagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcagtggtccaggccatggtggcagaatcaccccccagggtgtgacgcctcgtccctgtcaattccacacagctgcacccggaagagctgtggccgggcgccgctctgacctgtgtgcggtcccctgaatgggtctcaggtgtcttcagaatggtgaggccgcctcatttcctcaccacacaaccctcctgaggacgttgcctgcaaatgggcggaattcctaatttctaccattcagttaaacgagggatccttaagccccaaagctgggaaagctgtccgttaatttagtgcgcgtgggccgtctcagaacagcagggttcccaggagtccagcgggacgggggaggggatgagtggccgtgtccccctggcagagaaggccttgtctgaaggctacgcccgcctccggtacagggacacctccttgctcatctggcagcagcaacagcagaagttggagtcggtgccacctgggacgtacctgagcaggagccgaagcatgtggtactcacagtatggaaatgaggccatcttggtccgagacaaaaacaagctcgagctgtgcaagttcattcgcaaacgtcctagaagtggaactgctgggtcaaagtgcattccccaaatgtcctgccagaggcctggtcggcagcagcctcctgcacagcccgagtcccttctgcgagagtcctggcttgtttgcagcctgcagctgggagatttgaagtcagacttccaggattgccgcatggagctgcagagggagcctagttccagagctgtcattcttcggcgagccgcgctgcacgccagcctccagtctggcagttaaacctcactatgaaaatctgcttttgggattttatttgcatttccattagactgagcgcatcacaagccacttcaggatagactgagccggccgctcccccgacggctcacacaggcagcacctcactgccctgtggctggaggggcattgcaaggagcgccccccagccccaggcacccccggcttagggtgtacgtatcacccagccctgtgctggcagcacgttaccaaccagcctgcgtgaagacctgtcaactgtcgtgtgtgaattccttaaattcggtttaaatagtccattaaagatctgtttagaaaatacctttgaaaacgagggtaactttaaaaaatggaaactttcaaatccatttatatttttattataaacaaaacttaattaaaagtttaacaaactggctgaaaactcaccaagtgtcagactcaccagcaatttaaaaaatgataattta

SEQ ID NO: 466058 - DNA, 2789 bp, Homo sapiens
gacaaaggccacactcagcgcccgaaggaggggtgggggtgttgggaaagcgatgggggccaggactggggccaagtggccctggggatcctcgaggcggctcgacccgggagccaggactggcgccaagtggcccgggtccgggtccgggaagaggcggaggccggcgagggggcggtgcccggggccaacccagctccctccggccccgagggctcccgccccgcgcccctcccgggccctccagccgcgccccgggccggcgcagcgaccgcgcccgctcttccaccggcgtccggccaggaggcgcgaggcccaaggatgcgacccacgacgcgcacacccggctcggcaggctccctgggaaatgaggggccactcgcagggccccgcagagcgagcgcagcgccggagcctcccccatcccaggccgcgcagaccgcggaaccggcgcaccagagcagtgcccgcgggcggcggcggcgcgacccaggctgaggggactttggccaacttcgcgcctcctgaggtcgcgtctcggaggcccggggcgcaccctccagccgcccgcccgcgtcccggagcccggccgccccagccagggcgcctgggccgccgccgctgcgacctccgcgttcagtccgcgcgtcgggcagcgcgaacgccgcctccccggggccctcccgcccgccgggcgctcacctgggacatctgcggccggaagttgatgtccttgaggtcgatggagccgggggagaggttgtgcagcagctggcacagaaggaccccgtcgcgcagcgcctgcgccaggtcgaagaccacggccgagggccacaccacccggtggttgggcggcaggaccttgcaatcgatgagccagcggccgcactgccgccactgctccatggcgcccgcgggcccgaccggctcagggcagtgctcgagccaaagtgcagcggccgcggggcatcccgcccgcgcgcgcgcggggctcagggccggggcggggcttcgcgcgggctgccccaggtcccccgctgcgccgccgtgcgtcccctcctcttcctcctcctactcctcgggctcctctcgggccgccgctcccgcccacgtgcggccgcggggcgggcaacgggcagcgcgccggatctccccgcttcacacacgcaagtgcctgcgggccccgggccgggctccacgcagccagtcgccgcagcgctccccaatccgcgccgccgggcgccgcattctgcgctcggggcgccccgcggccgccgcggctcctgccccgcccgagacaaaggcccggcggggtcgctcgctccgcgcgtcccgggcctgggccgcccgcgtcgccgccgctttgttcgccccacccgcagtccccacgcccggcgctgcgactcgacgactcggcggctcggcggctccacggctccggggcgctgggggcgcagggggcgcggccacggccgggcggggcaggggcggggccggagcactcgcctggcacctccccgtgtcccaagcgccgcccccgcccccccacttcctgccccgctaccgcccgcgaaagttgcggtgggcgggggttgcggcgcaggcccaggtccggccgactttctccaagggcgctcggactttggggagcccttctccctgggggagcgacctcgcccgtggagtgatggccgggcgtccccccgggtgcctttggtcctccgtggaggtcaggaggtggtccctgtcgcgctgggcgccctcgcatggccgttcggtaacgacagactcgggagagggcaccgggctgggccgaagcttactgagcccccttggcccatcaagccgccccggcgggatacccgaggctgaggctgaaggcacacgggcccaggactcccagagccctcttcctgtcctccgccctggccgggggcccataggaagacccccgaccctgcataaaggccaggattccccagcttttggccaaagtcctggccactcgcagctgcccagcgggcagttcctggcgtccagggcggaatgcgtgacatgagtgagggcaggaaggtgctctccggcccaggcccggaggctggggtgcggtgtctgagggctcccaccctggactccggtggaatcctgggcctgtatgagctggggctgcactgcagcccccggaccccttaccccgtggcttccctgcgcaggggccggaacggggatgcgagcgcagagagggtcccctgggcccagggcctccgatggggcaagaagggggcctctgtcctcacggtcctgggcctgcctgctctggccaagaggaccagccaggtctgggacccaggcagccgcccgccaacaatgccatgggtacctgctgccccctggtggtgctgtcaccacggggcacctggctgcacccaggaggggctgcacagaaaatctggggttgaccgttgagaagacccaactcaggagacacagacttcaccacagtggccctgagccactcaggcctccctggttcccaggtcctgatcggcataggacattcaccggccctgtgcacctcccagaatccttggaggctctgagggcaggatggatgtgaatcaaagaacaaaagtttggtggggccaggtacagcagctcaagcctgtagtcccagcactttgggaggctcaggcaggcagatggcttgagtccaggagttcaagaccagcctgggcaacacagtgggtccctgtctcaaaaataaaataaaaggtaaagaaaatggggca

SEQ ID NO: 466059 - DNA, 794 bp, Homo sapiens
  misc_feature (6)..(9): n is a, c, g, or t
  misc_feature (12)..(13): n is a, c, g, or t
  misc_feature (15)..(16): n is a, c, g, or t
ggattnnnntcnntnnttattcatggtgagaacctggtaagctcctggaggtaaaactcacaaatgtgtggggacactcctatgactgggtctccttggagctggactctcagacattctgctgtattccttaatccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagctcccagcaagatagacgcagaaggcaggtgatttctgcatttccaactggggtacccggttcatctcattgggactggttggacagtgggtgcagcccatggagggcgagctgaagcagggtagagtgttgtctcacccaggaagtgcaaggggtcagggaattttctcccctacccaagggaagccatgagggacagagcctgaggaacggtgcactcc

SEQ ID NO: 466060 - DNA, 704 bp, Homo sapiens
acatatcggtaccgatgctctctctgtgggggaggtgtccagacccgcagggtgacctgtcaaaagctgaaagcctctgggatctccacccctgtgtccaatgacatgtgcacccaggtcgccaagcggcctgtggacacccaggcctgtaaccagcagctgtgtgtggagtgggccttctccagctggggccagtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatctgtgccaacactgaactagaacgtcctggtgctgtgtttaaggcatgatgggtagaaggaagagagactggagggcacatgaaaataaagcttaacagagaaagtaggcccaagtgcctggggatgggggcacccgacgcaagtctcacttcacactcctgcaaagtcggggagga

SEQ ID NO: 466061 - DNA, 1196 bp, Homo sapiens
gagcttcgggcctttgtgaaaatgtgtaagcaggatccgagcattctgcacaccgaggaaatgcgcttcctgagggagtgggtggagagcatgggaggtaaagtaccacctgctactcagaaagctaaatcagaagaaaataccgaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgagttattgacagacgccatcaagctgaatcctcgcttggccattttgtatgccaagagggccagtgttttcgtcaaattacagaagccaaatgctgccacccaagactgtgacagagccattgaaataaatcctgattcagctcagcctcacaagtggcgggggaaagcacacagacttctaggccactggggagaagcagaccatgatcttgcccttgcctgtaaattggattatgatgaagatgctagtgcaatgctgaaagaagttcaacatagggcacagaaaattgcagaacatcggagaaagtatgagcgaaaacatgaagagcgagagatcaaagaaagagtagaacgagttaagaaggctcgaaaagagcatgagagagcccagagggaggaagaagccagacgacagtcaggagctcagtatggctcttttccaggtggctttcctgggggaatgcctggtaattttcccagaggaatgcctggaatgggagggggcatgtctggaatggctggaatgcctggattcaatgaaattcttagtgatccagaggttcttgcagccatgcaggatccagaagttatggtggccttccaggatgtggctcagaacccagcaaatgtgtcaaaataccagagcaacccaaaggttatgaatctcatcagtaaattgtcagccaaatttggagccacgtgagatgtctctagctcctgatccactttggatttcctgtcctccaaccctttcctctgcccaccatgccaagcccatgaagatgatagagagcaatggttacatgggcacgc

SEQ ID NO: 466062 - DNA, 2073 bp, Homo sapiens
ggttgtgcatgagcccagaagtgactgttcacagctgcacccttgaatgcatccgaggagaggcatgacctctaccctatcccatcaccatgagccaaccccacaaacatggctacataggaacgggacaatgtaccccaaaataaaggaagccccggagtggaaccctgggctatcgtgcttctggggaaaggggctgacatggtccctgctgcaggatggtcactgctattacagtggtaccatcacgtaaaggctctgcagccactggacagcagtccttcaccatctgtagacaccccacccaagatggcatgaagacccctcaaagaagagctgatgaaacggatgacctggaaggagatgtttcgacaacttggcacagtaacgatgacgatgtgtatagggcgtctccaattgaccgttccatccttcccactgctccacgggctgctcgggaacccaatatcgaccggagccatcttcccaaatcgccaccctacactgcttttctaggaaacctaccctatgatgttacagaagagtcaattaaggaattctttcgaggattaaatatcagtgcagtgcgtttaccatgtgaacccagcaatccagtgaggttgaaaggttttggttatgctgaatttgaggacctggattccctgcttagtgccctgagtctcaaggaagagtctctaggtaacaggagaattcgagtggacgttgctgatcaagcacaggataaagacagggatgattgttcttttggccgtgatagaaatcgggattctgacaaaacaggtacagactggagggctcgtcctgctacagacagctttgatgactacccacctagaagaggtgatgatagctttggagacaagtatcgagatcgttatgattcagaccggtatcgggatgggtatcgggatgggtatcgggatggccaacgccgggatatggatccatatggtggccgggatcgctatgatgaccgaggcagcagagactatgatagaggctatgattcccggataggcagtggcagaagagcatttggcagtgggtatcgcagggatgatgtctcagaggaggcggggaccactatgaagaccgatatgacagacgggatgatcggtcttggagctccagagatgattactctctggatgattataggcgtgatgtccactcgagctgcttctatctttggaggggcaaagcccgttgacacagctgctagagaaagagaagtagaagaacggctacagaaggaacaagagaagttgcagcatcagctggatgagccaaaactagaacgacggcctccggagagacacccaagctggcgaagtgaagaaactcaggaacgggaacggtcgaggacaggaagtgagtcatcacagactgggacctccaccacatctggcagaagtaagtcagcccaggatgcacgaaggagagagaatgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcaatcccctacaagtggtgagggaaaagtagctccagctcaaccatctgaggaaggaccagcaaggaaagatgaaaacaaagtagatgggatgaatgtcccaaaaggccaaactgggaactctagccgtggtccaggagatggagggaacaaagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaat

SEQ ID NO: 466063 - DNA, 605 bp, Homo sapiens
tttaatgccaataatcatttataaaaatttcgggctttttgcgttctctttccctctcccaacacggcggcctcagcaaaaaagaagaagaagaaggggaagactatctccctaacagactttctggctgaggatgggggtactggtggaggaaggacctatgtttccaaaccagtcagctgagctgatgaaacggatgacctggaaggagatgtttcgacaacttggcacagtaacgatgacgatgtgtatagggcgtctccaattgaccgttccatccttcccactgctccacgggctgctcgggaacccaatatcgaccggagccatcttcccaaatcgccaccctacactgcttttctaggaaacctaccctatgatgttacagaagagtcaattaaggaattctttcgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaat

SEQ ID NO: 466064 - DNA, 1920 bp, Homo sapiens
aggaagtgcagaggaaatgcgacactacctttcctggaagacaaggccagtcttggtcgcctagcgctcattctaggcaatccacccaccatgaggggaaacgtggagaagaaggaagcttccctgtctgagacacgaatggaagccaggagctcccaggtcatgcgacctgcccaatcaagcagaaacacgtttggagagagaaacaatcacgacacggatctcgaagaaatgtctccctgacggactgggaagtcatctttgttgaagacattgggcgtcagcgagaggcattgaggcacttgagaaacagaccgtattgtggtgtggcttcatttctcagagaagagccgtgaaaagatacaagcatcttctctgacgtgggtccgctggtctccggcgggacaaagagctcctgtggggctcgtgtcctcgtctgcagtgtgttcatcttgatcctagaaaagagaccgctcaggatggggatatttcaattgctccgggaccgaagaatctcctcacgtgggccaggccttcacacacccaaagcggaaccgcgtcggcgaaaaggattgacaaccggtctcatgacccaggcagagaggcagaaacaggctcaccaaagacaggccaccatgcgagaaacagcttgtggtgcacagggcacattcggccaaggacacacacgcacacgggcacacacacacaaaccgacagagagagggaaagaaacacacagagactgagagacagagagagaagagagaatgggagacacacacacacatacacacacagacacacacacagagtcttatagcaaaggcattgaaagacacacacccaggcaacccctgaggctgtggggttctgctttcgacgagaaagacccttcggtgagagagcaccccaggggcacgcaggccgtcctgtcctcgagatcaccgcgtcacgacttttggggagactcacccccaccaacaccgtccagagaggcctgagggagggattccatgctgccttctccggactctgcgtcgggtttcctcaccctgttcggccctttgtgactcttggcatccggagactttcccctcgacccagtggagccgtcaggccggagcctcagagccttgacacccaagcactgccacggaagtctccccctttgccaagcctgggggactggtttctaagacaaccgtgggaaccactgtgacgggagaaactgcttgtgcttcgcgcatgcgcattggctgggccgactcgttctcccctcctggcagtcaggctgcgtcccctttaaagaacgccaccgctgagaactgaccctcacatctcccttcctgaatttctttagggaaagcaacaaccatccctgtaagccatggaggtgtctgggtactggtattttttcccccaaggagggtcggaggtggctggactttgggaaactgtgcaggagtgggtaggggacaatgcccgctcccaacacagcccagaagccccttccgtctgtctcctggtggctgagagctcgggcaagtggagaggcctaagggagaaaaatgaaaaagcagagtctggcttgagtcgttcggcccttcggcctaaaaccctctcaacagggaagccccgaacaggcgtcggagcggagagagcccacgaggcccagaggctgggggtatcgcagcgtcctccacccggtgttgttttcaaatgcgagggcacccagggctttctgaatgtgcgtgtgtgtgtgtgtgtgtgcgcgcgtgtgtgtgtgtgtgtgctggctttaaataagtgactcagtggatagtgtatttctcttttcagaccaaatgggtcaccggctactgaaaaagaatccagacctctgaaagggttcgtgacaaattttttagaagttctcacgct

SEQ ID NO: 466065 - DNA, 1882 bp, Homo sapiens
aggaagtgcagaggaaatgcgacactacctttcctggaagacaaggccagtcttggtcgcctagcgctcattctaggcaatccacccaccatgaggggaaacgtggagaagaaggaagcttccctgtctgagacacgaatggaagccaggagctcccaggtcatgcgacctgcccaatcaagcagaaacacgtttggagagagaaacaatcacgacacggatctcgaagaaatgtctccctgacggactgggaagtcatctttgttgaagacattgggcgtcagcgagaggcattgaggcacttgagaaacagaccgtattgtggtgtggcttcatttctcagagaagagccgtgaaaagatacaagcatcttctctgacgtgggtccgctggtctccggcgggacaaagagctcctgtggggctcgtgtcctcgtctgcagtgtgttcatcttgatcctagaaaagagaccgctcaggatggggatatttcaattgctccgggaccgaagaatctcctcacgtgggccaggccttcacacacccaaagcggaaccgcgtcggcgaaaaggattgacaaccggtctcatgacccaggcagagaggcagaaacaggctcaccaaagacaggccaccatgcgagaaacagcttgtggtgcacagggcacattcggccaaggacacacacgcacacgggcacacacacacaaaccgacagagagagggaaagaaacacacagagactgagagacagagagagaagagagaatgggagacacacacacacatacacacacagacacacacacagagtcttatagcaaaggcattgaaagacacacacccaggcaacccctgaggctgtggggttctgctttcgacgagaaagacccttcggtgagagagcaccccaggggcacgcaggccgtcctgtcctcgagatcaccgcgtcacgacttttggggagactcacccccaccaacaccgtccagagaggcctgagggagggattccatgctgccttctccggactctgcgtcgggtttcctcaccctgttcggccctttgtgactcttggcatccggagactttcccctcgacccagtggagccgtcaggccggagcctcagagccttgacacccaagcactgccacggaagtctccccctttgccaagcctgggggactggtttctaagacaaccgtgggaaccactgtgacgggagaaactgcttgtgcttcgcgcatgcgcattggctgggccgactcgttctcccctcctggcagtcaggctgcgtcccctttaaagaacgccaccgctgagaactgaccctcacatctcccttcctgaatttctttagggaaagcaacaaccatccctgtaagccatgggttttcatgcggaggaaggagagggctagttgtctgagagggtaactgcttaaggctgcagactaggaaatgggattccaggtttaagatagctcctttctggacctcagtccttcacctagtcacctagtcacagggtggattgcctctaaggatacttaggggaaaaggaaccaaatttgggatggttctccttgctttaagccttgataggagacggggaggccaacccttctctgcagaccgtgatcctcactagacagaggagctccaaacctgcccatctcatcccatgcaccgacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaaaaaaaa

SEQ ID NO: 466066 - DNA, 428 bp, Homo sapiens
tgagggaccgtagaggtgtggcaggatagctcctttctggacctcagtccttcacctagtcacctagtcacagggtggattgcctctaaggatacttaggggaaaaggaaccaaatttgggatggttctccttgctttaagccttgataggagacggggaggccaacccttctctgcagaccgtgatcctcactagacagaggagctccaaacctgcccatctcatcccatgcaccgacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaaaaaaaa

SEQ ID NO: 466067 - DNA, 1310 bp, Homo sapiens
aggaagtgcagaggaaatgcgacactacctttcctggaagacaaggccagtcttggtcgcctagcgctcattctaggcaatccacccaccatgaggggaaacgtggagaagaaggaagcttccctgtctgagacacgaatggaagccaggagctcccaggtcatgcgacctgcccaatcaagcagaaacacgtttggagagagaaacaatcacgacacggatctcgaagaaatgtctccctgacggactgggaagtcatctttgttgaagacattgggcgtcagcgagaggcattgaggcacttgagaaacagaccgtattgtggtgtggcttcatttctcagagaagagccgtgaaaagatacaagcatcttctctgacgtgggtccgctggtctccggcgggacaaagagctcctgtggggctcgtgtcctcgtctgcagtgtgttcatcttgatcctagaaaagagaccgctcaggatggggatatttcaattgctccgggaccgaagaatctcctcacgtgggccaggccttcacacacccaaagcggaaccgcgtcggcgaaaaggattgacaaccggtctcatgacccaggcagagaggcagaaacaggctcaccaaagacaggccaccatgcgagaaacagcttgtggtgcacagggcacattcggccaaggacacacacgcacacgggcacacacacacaaaccgacagagagagggaaagaaacacacagagactgagagacagagagagaagagagaatgggagacacacacacacatacacacacagacacacacacagagtcttatagcaaaggcattgaaagacacacacccaggcaacccctgaggctgtggggttctgctttcgacgagaaagacccttcggtgagagagcaccccaggggcacgcaggccgtcctgtcctcgagatcacctagtcacagggtggattgcctctaaggatacttaggggaaaaggaaccaaatttgggatggttctccttgctttaagccttgataggagacggggaggccaacccttctctgcagaccgtgatcctcactagacagaggagctccaaacctgcccatctcatcccatgcaccgacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaaaaaaaa

SEQ ID NO: 466068 - DNA, 818 bp, Homo sapiens
gaaaccagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggcggggacgggggaagcagcacgggatcccagcctcaggcctgcccggacggtgttggttggggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgcctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacaaacaccacacacacgcacaccaaaacaaagctccgaggggcaccacatagtgcccggggcgccggaaaacagcggtacgcaaagggcccccggcgcaatagacggtccccggaccccggcttcttggcccaacggggagaacgggcggtcccctaaaggggccgataaacgcataggccggtaccgcaaaacgcgag

SEQ ID NO: 466069 - DNA, 1789 bp, Homo sapiens
gaaaccagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggcggggacgggggaagcagcacgggatcccagcctcaggcctgcccggacggtgttggttgggaccgtattgtggtgtggcttcatttctcagagaagagccgtgaaaagatacaagcatcttctctgacgtgggtccgctggtctccggcgggacaaagagctcctgtggggctcgtgtcctcgtctgcagtgtgttcatcttgatcctagaaaagagaccgctcaggatggggatatttcaattgctccgggaccgaagaatctcctcacgtgggccaggccttcacacacccaaagcggaaccgcgtcggcgaaaaggattgacaaccggtctcatgacccaggcagagaggcagaaacaggctcaccaaagacaggccaccatgcgagaaacagcttgtggtgcacagggcacattcggccaaggacacacacgcacacgggcacacacacacaaaccgacagagagagggaaagaaacacacagagactgagagacagagagagaagagagaatgggagacacacacacacatacacacacagacacacacacagagtcttatagcaaaggcattgaaagacacacacccaggcaacccctgaggctgtggggttctgctttcgacgagaaagacccttcggtgagagagcaccccaggggcacgcaggccgtcctgtcctcgagatcaccgcgtcacgacttttggggagactcacccccaccaacaccgtccagagaggcctgagggagggattccatgctgccttctccggactctgcgtcgggtttcctcaccctgttcggccctttgtgactcttggcatccggagactttcccctcgacccagtggagccgtcaggccggagcctcagagccttgacacccaagcactgccacggaagtctccccctttgccaagcctgggggactggtttctaagacaaccgtgggaaccactgtgacgggagaaactgcttgtgcttcgcgcatgcgcattggctgggccgactcgttctcccctcctggcagtcaggctgcgtcccctttaaagaacgccaccgctgagaactgaccctcacatctcccttcctgaatttctttagggaaagcaacaaccatccctgtaagccatgggttttcatgcggaggaaggagagggctagttgtctgagagggtaactgcttaaggctgcagactaggaaatgggattccaggtttaagatagctcctttctggacctcagtccttcacctagtcacctagtcacagggtggattgcctctaaggatacttaggggaaaaggaaccaaatttgggatggttctccttgctttaagccttgataggagacggggaggccaacccttctctgcagaccgtgatcctcactagacagaggagctccaaacctgcccatctcatcccatgcaccgacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaaaaaaaa

SEQ ID NO: 466070 - DNA, 1176 bp, Homo sapiens
ggaaggcggcggaggacagcaaggtggctggccggcaggccaatggcggccaacgccacttccggccgccctccgagcatcgctcttcggcaacccgaagccacaggatggaggagggggatcccagcaaaggtagcgactaaggggacccaagcagaacgggagggcgacgtccggagcggcggcagagccaggggacgctgtgtgaggctggcaaagcggtgttcacctagttctctcgggctccgccgccgccggaggaggacaggaggccggcaaggcgacccccaaatcttcctaggctctgacttccgtctcctaacccccgcaaattccaacccggtcttggaaaatcccgcgagaacgggctcccgaattgtcattgggatctcgcgagaacgaaatcttcctttctgtgggcggagcaatcttcccgatgtctcttccctctgaggccagtagcaggaagggcctcgggagttgcgagtgtcgcgaggtttgaggtcgctcggtgggccgggcgctgtgcgaagctagaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgtctgcactgagcccgggagcatcttcagggcagcgccgcccacgcgcgaggtgaatgaaggacacggcctcttgacactcccaggcagcacagatagacggatcctggctagaagtgaccccaggatttttttattatcaagagagactagaagaatcatgagacttttcctagttgcctttcaagaatatgaagaaaaaaatggttctcaaagtgggtttgaatgagtattgttccaataaatgaacttatattcatatttca

SEQ ID NO: 466071 - DNA, 1121 bp, Homo sapiens
ggaaggcggcggaggacagcaaggtggctggccggcaggccaatggcggccaacgccacttccggccgccctccgagcatcgctcttcggcaacccgaagccacaggatggaggagggggatcccagcaaaggtagcgactaaggggacccaagcagaacgggagggcgacgtccggagcggcggcagagccaggggacgctgtgtgaggctggcaaagcggtgttcacctagttctctcgggctccgccgccgccggaggaggacaggaggccggcaaggcgacccccaaatcttcctaggctctgacttccgtctcctaacccccgcaaattccaacccggtcttggaaaatcccgcgagaacgggctcccgaattgtcattgggatctcgcgagaacgaaatcttcctttctgtgggcggagcaatcttcccgatgtctcttccctctgaggccagtagcaggaagggcctcgggagttgcgagtgtcgcgaggtttgaggtcgctcggtgggccgggcgctgtgcgaagctagaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgtctgcactgagcccgggagcatcttcagggcagcgccgcccacgcgcgagtggctagaagtgaccccaggatttttttattatcaagagagactagaagaatcatgagacttttcctagttgcctttcaagaatatgaagaaaaaaatggttctcaaagtgggtttgaatgagtattgttccaataaatgaacttatattcatatttca

SEQ ID NO: 466072 - DNA, 2110 bp, Homo sapiens
ctttgccagcttctgtccacattccttggctttggtcccttcctccatcttcaaagccagtgatatgccatctctctgaaccttccatcctcaagtctaccgctgattgcagctggaaaagattctgagggctcacctgagtaatccaggatcatcttcccatttccaggtctctgcccttgatcacatcagcagaatccttttgccattggctagaagtgaccccaggatttttttattatcaagagagactagaagaatcatgagacttttcctagttgcctttcaagaatatgaagaaaaaaatggttctcaaagtgggtttgaatgagtattgttccaataaatgaacttatattcatatttcatcccctgagtcctggtgtttcaacatccattagaactgaataatcatactgcatatcaaagtttgtgggaaattgctaaagtgtaaaaaatgctcatattgaaaaagaagaaaagctgaaaattaattgtgcttccaactttaaaaaaggacaacaagctaatcctaaagaaactagaataaaaggaaaaaataaacagaagttaaagagtaattttaaaaaatacaatagaaattatcaacgaagccaaaagttgattctttgaaaagattaatgaagtaggcaaaccactggtgagatgaatcaagaaaaatagagaaaagactcaaataaacattaggaatggaaaatagggcaatgctaaagagaattcaaagatcagaaaaatatgggagtatactaaaaacgatttcatgcccaagtgttcaaatctatattgcctttaaaaatatataaaaaaggagccggacactggctcatgcctataatcccagcactttggaaggctgaggtgggtgaatcacaaggtcaagagatcaagaccatcctggctaacacagggaaaacccgtctctactaaaaatacaaaaaattagctgggcgtggtggcacacgcttatagtcccagctgctcaggaggctgaggcaggagaattgcttgaacccatgaggcagaggttgcagcgagcagagatggccccactggactccagccttggcgacagagagagactccatctcaaaaaaaaaaaaaaaaatcaaaaaggaaaagaagcactgaagaaatccataaccgttggagaagcttgaatcagtagttgataatgtccctccaagaaaagaccagatgtaagtgactgtacaggaaagttctgccaaatgtcaaagggaatagataaatatcacataaactcttccagagaatacaagaaaaggaacactccccaacttattttataaacttggttaaatcttgatagcaaaatttaataaggacaccatgacaagtgaaattataagcaaattttacttacagttatatgcaaaagttctaaacaaaatactggacaactgaatctaattttgaataatactagcaagaataataataataacaataataataataataatgcatcatgaccaagttgggtttacctcaagaatgcaaatatagtttaaaactggaaaatctagtagtgaaatttaccacactaagaaataaagaagaaaaattatgtcatctcaacagatcgaaaaattttctaaaatccaaccaaatattagcaaaaaagcaataaaggaaaatttcttaacttaataaagagtatctattcgaaacctgcagcaagcatgatagttaatgatgaaatgttagacactgtctttttaaaaccataaacacaatgatatctgttatcactacttctactcatcattgatcttaaccatttcaataataaaagatactatatataaattatagatattgagaaggaagaccaaaactgctactattcacaaacaatattattattcacctaaaaagcaagagaatatgcaagtaaatctttagaataagagaattcaatatggtttgaggatacaagtgcaatttataaaaatcaactgtatttctatacactagctacacaagttagaaaatataatttttaaaatgtatttttacagtagcaaccaataatatataagaatagctaataattatctaaaaatgtgtg

SEQ ID NO: 466073 - DNA, 2958 bp, Homo sapiens
ggaaggcggcggaggacagcaaggtggctggccggcaggccaatggcggccaacgccacttccggccgccctccgagcatcgctcttcggcaacccgaagccacaggatggaggagggggatcccagcaaaggtagcgactaaggggacccaagcagaacgggagggcgacgtccggagcggcggcagagccaggggacgctgtgtgaggctggcaaagcggtgttcacctagttctctcgggctccgccgccgccggaggaggacaggaggccggcaaggcgacccccaaatcttcctaggctctgacttccgtctcctaacccccgcaaattccaacccggtcttggaaaatcccgcgagaacgggctcccgaattgtcattgggatctcgcgagaacgaaatcttcctttctgtgggcggagcaatcttcccgatgtctcttccctctgaggccagtagcaggaagggcctcgggagttgcgagtgtcgcgaggtttgaggtcgctcggtgggccgggcgctgtgcgaagctagaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgtctgcactgagcccgggagcatcttcagggcagcgccgcccacgcgcgaggtgaatgaaggacacggcctcttgacactcccaggcagcacagatagacggatccgtctctgcccttgatcacatcagcagaatccttttgccattggctagaagtgaccccaggatttttttattatcaagagagactagaagaatcatgagacttttcctagttgcctttcaagaatatgaagaaaaaaatggttctcaaagtgggtttgaatgagtattgttccaataaatgaacttatattcatatttcatcccctgagtcctggtgtttcaacatccattagaactgaataatcatactgcatatcaaagtttgtgggaaattgctaaagtgtaaaaaatgctcatattgaaaaagaagaaaagctgaaaattaattgtgcttccaactttaaaaaaggacaacaagctaatcctaaagaaactagaataaaaggaaaaaataaacagaagttaaagagtaattttaaaaaatacaatagaaattatcaacgaagccaaaagttgattctttgaaaagattaatgaagtaggcaaaccactggtgagatgaatcaagaaaaatagagaaaagactcaaataaacattaggaatggaaaatagggcaatgctaaagagaattcaaagatcagaaaaatatgggagtatactaaaaacgatttcatgcccaagtgttcaaatctatattgcctttaaaaatatataaaaaaggagccggacactggctcatgcctataatcccagcactttggaaggctgaggtgggtgaatcacaaggtcaagagatcaagaccatcctggctaacacagggaaaacccgtctctactaaaaatacaaaaaattagctgggcgtggtggcacacgcttatagtcccagctgctcaggaggctgaggcaggagaattgcttgaacccatgaggcagaggttgcagcgagcagagatggccccactggactccagccttggcgacagagagagactccatctcaaaaaaaaaaaaaaaaatcaaaaaggaaaagaagcactgaagaaatccataaccgttggagaagcttgaatcagtagttgataatgtccctccaagaaaagaccagatgtaagtgactgtacaggaaagttctgccaaatgtcaaagggaatagataaatatcacataaactcttccagagaatacaagaaaaggaacactccccaacttattttataaacttggttaaatcttgatagcaaaatttaataaggacaccatgacaagtgaaattataagcaaattttacttacagttatatgcaaaagttctaaacaaaatactggacaactgaatctaattttgaataatactagcaagaataataataataacaataataataataataatgcatcatgaccaagttgggtttacctcaagaatgcaaatatagtttaaaactggaaaatctagtagtgaaatttaccacactaagaaataaagaagaaaaattatgtcatctcaacagatcgaaaaattttctaaaatccaaccaaatattagcaaaaaagcaataaaggaaaatttcttaacttaataaagagtatctattcgaaacctgcagcaagcatgatagttaatgatgaaatgttagacactgtctttttaaaaccataaacacaatgatatctgttatcactacttctactcatcattgatcttaaccatttcaataataaaagatactatatataaattatagatattgagaaggaagaccaaaactgctactattcacaaacaatattattattcacctaaaaagcaagagaatatgcaagtaaatctttagaataagagaattcaatatggtttgaggatacaagtgcaatttataaaaatcaactgtatttctatacactagctacacaagttagaaaatataatttttaaaatgtatttttacagtagcaaccaataatatataagaatagctaataattatctaaaaatgtgtg

SEQ ID NO: 466074 - DNA, 1216 bp, Homo sapiens
ggaaggcggcggaggacagcaaggtggctggccggcaggccaatggcggccaacgccacttccggccgccctccgagcatcgctcttcggcaacccgaagccacaggatggaggagggggatcccagcaaaggtagcgactaaggggacccaagcagaacgggagggcgacgtccggagcggcggcagagccaggggacgctgtgtgaggctggcaaagcggtgttcacctagttctctcgggctccgccgccgccggaggaggacaggaggccggcaaggcgacccccaaatcttcctaggctctgacttccgtctcctaacccccgcaaattccaacccggtcttggaaaatcccgcgagaacgggctcccgaattgtcattgggatctcgcgagaacgaaatcttcctttctgtgggcggagcaatcttcccgatgtctcttccctctgaggccagtagcaggaagggcctcgggagttgcgagtgtcgcgaggtttgaggtcgctcggtgggccgggcgctgtgcgaagctagaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgtctgcactgagcccgggagcatcttcagggcagcgccgcccacgcgcgaggtgaatgaaggacacggcctcttgacactcccaggcagcacagatagacggatccgtctctgcccttgatcacatcagcagaatccttttgccattggctagaagtgaccccaggatttttttattatcaagagagactagaagaatcatgagacttttcctagttgcctttcaagaatatgaagaaaaaaatggttctcaaagtgggtttgaatgagtattgttccaataaatgaacttatattcatatttca

SEQ ID NO: 466075 - DNA, 2918 bp, Homo sapiens
ggaaggcggcggaggacagcaaggtggctggccggcaggccaatggcggccaacgccacttccggccgccctccgagcatcgctcttcggcaacccgaagccacaggatggaggagggggatcccagcaaaggtagcgactaaggggacccaagcagaacgggagggcgacgtccggagcggcggcagagccaggggacgctgtgtgaggctggcaaagcggtgttcacctagttctctcgggctccgccgccgccggaggaggacaggaggccggcaaggcgacccccaaatcttcctaggctctgacttccgtctcctaacccccgcaaattccaacccggtcttggaaaatcccgcgagaacgggctcccgaattgtcattgggatctcgcgagaacgaaatcttcctttctgtgggcggagcaatcttcccgatgtctcttccctctgaggccagtagcaggaagggcctcgggagttgcgagtgtcgcgaggtttgaggtcgctcggtgggccgggcgctgtgcgaagctagaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgtctgcactgagcccgggagcatcttcagggcagcgccgcccacgcgcgaggtgaatgaaggacacggcctcttgacactcccaggcagcacagatagacggatcctggctagaagtgaccccaggatttttttattatcaagagagactagaagaatcatgagacttttcctagttgcctttcaagaatatgaagaaaaaaatggttctcaaagtgggtttgaatgagtattgttccaataaatgaacttatattcatatttcatcccctgagtcctggtgtttcaacatccattagaactgaataatcatactgcatatcaaagtttgtgggaaattgctaaagtgtaaaaaatgctcatattgaaaaagaagaaaagctgaaaattaattgtgcttccaactttaaaaaaggacaacaagctaatcctaaagaaactagaataaaaggaaaaaataaacagaagttaaagagtaattttaaaaaatacaatagaaattatcaacgaagccaaaagttgattctttgaaaagattaatgaagtaggcaaaccactggtgagatgaatcaagaaaaatagagaaaagactcaaataaacattaggaatggaaaatagggcaatgctaaagagaattcaaagatcagaaaaatatgggagtatactaaaaacgatttcatgcccaagtgttcaaatctatattgcctttaaaaatatataaaaaaggagccggacactggctcatgcctataatcccagcactttggaaggctgaggtgggtgaatcacaaggtcaagagatcaagaccatcctggctaacacagggaaaacccgtctctactaaaaatacaaaaaattagctgggcgtggtggcacacgcttatagtcccagctgctcaggaggctgaggcaggagaattgcttgaacccatgaggcagaggttgcagcgagcagagatggccccactggactccagccttggcgacagagagagactccatctcaaaaaaaaaaaaaaaaatcaaaaaggaaaagaagcactgaagaaatccataaccgttggagaagcttgaatcagtagttgataatgtccctccaagaaaagaccagatgtaagtgactgtacaggaaagttctgccaaatgtcaaagggaatagataaatatcacataaactcttccagagaatacaagaaaaggaacactccccaacttattttataaacttggttaaatcttgatagcaaaatttaataaggacaccatgacaagtgaaattataagcaaattttacttacagttatatgcaaaagttctaaacaaaatactggacaactgaatctaattttgaataatactagcaagaataataataataacaataataataataataatgcatcatgaccaagttgggtttacctcaagaatgcaaatatagtttaaaactggaaaatctagtagtgaaatttaccacactaagaaataaagaagaaaaattatgtcatctcaacagatcgaaaaattttctaaaatccaaccaaatattagcaaaaaagcaataaaggaaaatttcttaacttaataaagagtatctattcgaaacctgcagcaagcatgatagttaatgatgaaatgttagacactgtctttttaaaaccataaacacaatgatatctgttatcactacttctactcatcattgatcttaaccatttcaataataaaagatactatatataaattatagatattgagaaggaagaccaaaactgctactattcacaaacaatattattattcacctaaaaagcaagagaatatgcaagtaaatctttagaataagagaattcaatatggtttgaggatacaagtgcaatttataaaaatcaactgtatttctatacactagctacacaagttagaaaatataatttttaaaatgtatttttacagtagcaaccaataatatataagaatagctaataattatctaaaaatgtgtg

SEQ ID NO: 466076 - DNA, 784 bp, Homo sapiens
gtcacacgtccagaggccgagccgtcgcgtacctaggatgccgcgtggaagccgaagccgcacctcccgcatggcccctccagccagccgggcccctcagatgagagctgcacccaggccagcaccagttgctcagccaccagcagcggcacccccatctgcagttggctcttctgctgctgcgccccggcagccaggtctgatggcccagatggcaaccactgcagctggcgtggctgtgggctctgctgtggggcacacacagggtcacgccgttaccggaggcttcagtggaggaagtaatgctgagcctgcgaggcctgacatcgcttaccaggagcctcagggaacccagccggcacagcagcagcagccttgcttctatgggatcaaacagtttctggagtgtgcccagaaccagggcgacatcaagctctgtgaggatttcagtaaggtgctgaaacatcagcctgactccatgcatgcatcgcctgcaacccagcaattccacttccagaaacacaatctgcaggaattcccacacatgagcgtaagaagactgtccaaagatgtgcattgcagccctgtttataacagaaaagagtggaaacagctttcatctgtaaggaacaggataatagaactggagattaattcatttttatgaaagtatacaagagttaaaatgaattgactgcttctacccggataaatctcagaaacacaatggtgaattaaaaaacaattgaaaatgaaatacacagtagcataccatttgtgtaaa

SEQ ID NO: 466077 - DNA, 2348 bp, Homo sapiens
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagacctccgaggattgcgtcttcaacagtgacgagtcagagaatgtcacggcggtggctgaggtgctcctgtattcctggcagatagccgacatctcagtctctgaggtgcctgtggtcctgactaggaagggggtgccaaaagcacccatcaggcctgccgcacctgccctggacagctctgggaaaaggggcttcccaatctcacactggcctgtggcccagaggcttcgcatcaccaaagggaaagacctgcagatcacccccgcccagcccccagcgacccagaccctgaggggtggggctgctagggccctatgtactggggctaaaagccccctggccatgcacaaggtttgtgggcttatttcagggacagggctaggaggggatgagagcagagcagcagctaccatgaagtgcctggagcaagcctcacctcgtcctgggcagccccgcaacagtgttactcccgctctagagccactcgccccaggccacccagctgtcagcagcggggccgaacgcacacctaggccagcggtcttcgacccctgagctttgactaccctgctgccttagcttcctgaggcctggcggaagcaccagggacttacagctcatgctggaggctgaagaggtctggtcaaggtagctgtcagacagggacgccaccttgctaggtatgagctctgattttttctcctatggcaagaaacaggctttgtagttcagatggtaggaggcccgtgcagctgcacctctagaaggccagcagccctgggcccctcggtggtcattctcctgagcttggaggtctttgaaggtgccaggttagagtggggtggggacacgcagaggctaagcctggcaggaaggggagcgaccaggctagacaggcatggtgccgtgagaacggttgtgttgaaggagctgctagcgccttggtttttttcaactgcaaaatgaaaattagttcaggtgtggaacaggcttctgtaaattgtaaagggctgtgccctggggaatgcttacggaggacttgaggagcttctgtaggctttacccccatccattctcccaatacaagtgaagacggagggatggggagagctgctaatgaccatttcactgaacaggaaaccaaagctcagagcccctaagcaacctgtccagggccactcggctaagaagcagagaggccgggtttgaatccaggtctgctggctgccacagccagaccctacctaggctgc

SEQ ID NO: 466078 - DNA, 1638 bp, Homo sapiens
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 466079 - DNA, 1372 bp, Homo sapiens
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 466080 - DNA, 1244 bp, Homo sapiens
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 466081 - DNA, 2221 bp, Homo sapiens
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccagaggactgttgctaagacttttaattgctctggaaggaggcagctggctgagtgccagtgtggggaggtgggtagaactcatcccctccccagcaagaagggagggtctggatggtcccttcagacagcttcatagtaggtgaggtcctgatcaacctcagttttgctgagacttgggctgggtccccaggtggactcggccttgctggaagttgagctcatgccctggctcttgccctgggcaccctcagccttgctggacctctggccctggccttgggcatactcagtcttgctgaggctccagtttgagtcatagaaagcctcagtcttggtggaacttcggagcagtcccctgcttcggccctgggtggcatcaaccttgctgggtctccagctccggccacgagcagccttgacctttctgggcctctgccttgggctccgggtggtcttggtcttgctgggctcctgccttgggccctgggtggcctcaatctcgctggagctctgcctctggccctgagtggcctcagtcttgctggagctctgcccctggccctgggtggccctggtcttgctgga

SEQ ID NO: 466082 - DNA, 1068 bp, Homo sapiens
  misc_feature (1015)..(1015): n is a, c, g, or t
  misc_feature (1022)..(1022): n is a, c, g, or t
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcacccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggccantggctgncaaggtcgtttcaggtggtggagcccttttccgaaagaggttctcg

SEQ ID NO: 466083 - DNA, 1153 bp, Homo sapiens
  misc_feature (1153)..(1153): n is a, c, g, or t
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcaccacatggttctcaactggcatcatggaaaggctctagagagggtgccttctccgtcagggacagtcgcatggtgtcaagagtgccagtggcttgagcacggtgaggtgtcagtggtggagcactttctgaaaaggagtttctcaggggagaagggccggaggttctgattgtgggtggccttggggtggaggtggttttgaccattgtatagtgttggaagaaggggagagaggcgaaaaattaaggaaagggcgctctctcaacaaatgn

SEQ ID NO: 466084 - DNA, 716 bp, Homo sapiens
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtgaggcgccagggagcccggagcgaggggcgggcggacgcgggcagacgcgggagcgctgggagccctgggagcccggctggcgccggccagagaagctgaggacccagagggtgggaccgaggggcggggcccgcagacttgggagggtggagggtacccgttgaggtccaggaggccctgccaacctggagagaggcctcagccagcagaacccttggtggaagttcttgggcctccccggaatggcctggccgtcaaaggagaagtgcagtgcgccttggggatgggcggggtctgcggctgaccccgttgacagctcgcatttagagctgagtgcaatctagaggaccgcctggtgggggcgctgccgagctgaatcaggcccgaaggtggctctttt

SEQ ID NO: 466085 - DNA, 2617 bp, Homo sapiens
  misc_feature (786)..(786): n is a, c, g, or t
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcaggtggggcccggctttgcagtgggcacagtgngggggccacttctcagaggttcagctctacagccttagcctgtgctcccagcagaatccagttccccatgggcttagctgggctttcccagtgccctccgccactctcagagatgacattgtcattccgcctggttgatttccctttggacattctcagcaaattctgggctcagtctttttgatcgccacttctttgtggaagccctgccaggtcaagaagttttccctcttttgtggtgaggaggacacaggcctgggaaaaataggaacagagttcttgtcctttagtcccagctctcagaatcctcgctgtgtttcctcaggcagcatggctccgcctctctgagcctctgtctctgcttctgaacagcggggccaataatgatgccccgatgccttcctggaagttcagtgagggaaagtcagttgagggacacaaaagtgttttgtaaactataaagtacgtggcatgtgtaggtgaattacaggggccatggatgtggacaccatggagggggaagtggagcgttttcagtggagttggctcctccccgcactgagccatgttcctatgtcaggtggcagcggggaagcgagggtccaatcctgccctgcgctagtcctcatctgagtctcagcctgggtcccccatggttttagcaacacgggtggcgagcagatcaaccaggtggcattggaggcgtggcgcagccggcgggaccgcgaggagatcctcctgcaggagctggagccggtcatctcccgcgcggtgctggacaacccgcacccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 466086 - DNA, 1658 bp, Homo sapiens
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcacccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 466087 - DNA, 864 bp, Homo sapiens
  misc_feature (7)..(7): n is a, c, g, or t
  misc_feature (9)..(9): n is a, c, g, or t
  misc_feature (85)..(85): n is a, c, g, or t
ggaaggntntggccaaaaccggcgggggcccccccggggaagaccctcccttcaaggaacttggaacccgggtaatctccccccncgggttcctggacaaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 466088 - DNA, 2035 bp, Homo sapiens
cgcggcccgccgtcccggattggacggttcgcgggttccccctggaggccaccttctggtcctgctgcggaacgacgggcgggccttggaggcggggagaggagcgtcgggagttgtaggcgatgggcgtggctgctgcggagcgctcgggcctcagcccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccagaaaaccaaaacaaaaaaaaaccacaaaaaaaaaaaaaaacacaaacacaaacaaacaaaagcacagcaaccagaacacaacaaacacaaaaaaaaacaaacggggggcggaagcagaaacacacacacccagggggaggacaacagagagacgaacaccaccgcaaaggctagcaacacgaagggcccccacaaagaggaagagaacaaaataacggagaaagcagagagcagacacaagaaaaaacacgagcagacgacaagagcacaaaagagaacagaacggaaagacactagcgaacagagagcgcccacaacgcagacgagagggcagaacaaaaagagggggacacacagcgaccgagagaagcaaaagagaacgccacgaggggcgaacga

SEQ ID NO: 466089 - DNA, 1473 bp, Homo sapiens
gagccaccatgactggcctgcaacggcatcttgaatgctgcatccttgggggatggggtgaggtgaggaacagaatgctcttcctcacatggcagaagagagaaaggggcaagagagggccaaacttgcccttttataatagcaccaatcctacccatgaaggtgacgccctctgtggtaatgaggagagttcaccaaagtccatctccaactcaggcatgtctggatccaacccgttttgggggctgagctccttcctggaactttttgaaacaagaactgaaggtgcaacagttacacatgcggaaaacctggggcccctgggttatgatatgactttgcacatttgggtgattagttctgtggtacttagaaagattctctccttgaccaaactctactcagactcctctgagctcttttacaaattaattttggcaagaatcctgctaagtcaaaagccagtctggaagctctgagattccttcctcaccttggtctattttgctattattacttgtgattggattacgaaattgttgtagtgtgttctccagctctatcaggtcagttatgttcttttctataatggctattttgcctgtcaactcttgcattgttgtattatgaatcttagctttggcttcctgagatggagtttcatcattctcctgaatgatcttcattcctatccatattctgaattctatttctgtcatttcaatcatttaagcctggttaaaaacccttgatcgagaactaatgcagtcattaggaggaaagaagatactctctggctttttgagttgtcagagttctttcactggttctttctcatctttgtgggctgatgttctttcagtcttttaagttgttgtcttttagattttttttttcttttatcctgtttgatgaccttatgggtttgattgtggcataaggtgggttgagttgactggcttcgttactggaagattttagggggccaagactcacctcaggactcctggactgcatgctctaactctgggggacttatatcaggccctagctttgttctctggctccttgacgttaggaacctgctgtgctggaggggctgtggtgctcccagaccaaaggtcacaacactctgatgggaggtcccagccaaagcactttgtagggtggtggcagcaggatccatcctcatttgcatgtgttagcagcagtggcaatggaagcacactgtggtccatgctcatcagttgcagcatggtgccagcgggtgccagttctctgcaggtgcgagcctctctgtggacattcacagaagtggccatggtagtatggcatgggggtgggtggaggcccctccagcagttgtgtgcacattcatgccagttgtggtgttagcacaggggtgggacgctgatgaccgcaggactgtgtgcaccctctgtgtgtattcatgctggtggtgatggccactca

SEQ ID NO: 466090 - DNA, 1452 bp, Homo sapiens
taacttgggtcacaccccctaactgatcctcctctagagaccggaaatgggccaggggaccatccatcaaagccgccctggacgctgggccagactgcccgccgccggcaccgaccgggtctctccatatcgcattagcgtggggcgagggctcagtgcggcactggctgctgagggagaggcacctattctttgttgttattattgttgttgctttcatctgattttaattgttttatgttttttgaataagaaatacacgtacatggttcaaaactcaaaaggcaccaaaagttatacagtgacaaactcggatagatcccctcatgggaacctatggatctatggcatatctatggatatgccaccccatggcaactgtcctttccccttcatagcatacatcaccctgaattatagctgcctgtttatgtatgtgtcttctgcaccagccacattgggggttgtggttgatgctgtgaggtcattcctgccttattcaacttcatgtccaaatcttctaatggcaaaacaaaacatggtggccaagtctcagagtccaggcatccctcccatagcccatagccaacttcggtttgatgtaccagcatcaggcactgctcaagcttctgagcacagcatcccctctgcctgcaaacttttccctccagcactttctgcttggggaattgctgttcctctttcaaaaccaacccagttccaccccaagtaatggtgcagtgggatctttacctctctgggccacagtcttctcatctgtaaaatgaggataagatactaggaggggttgagggtctgggaaggtttcatgagacagcttgtcagtgaccagcacagggtaggtccccagcagtggctgtttccttctctgtagtctaaccataagccttcctgctgtgccttcctgcactgcctcttaattctgctttcaaaggagctagtggcagtgaccctcgccccttaaagaaactctcaggagagcattgttcctcattcatttgtccaaattctctctcttcctctgggaaaccctgaaaaagagggataacaaagctgaactggagccccaacctgctctgtccccacctcctctgcacccaggtgagccagtcagggtggcaacagaaaataaatgacacattcgagagggtttcactgaagggtttagtgatgtggcagtttctaaagccatagatcagatgaagaaaactaataagggctagtgtggcaccaggatagaaatatctctaccaaagcccatgccaactgggctcacgggacacaggagagaggccactcagcaaagctgtgaccaaggaggaaacacaaccaccaccagagctgcaagcaggcaaaaaggggggctgacagggaatggaggaaacaaataccctgactcctctctcccccttctcagccgggaactctatt

SEQ ID NO: 466091 - DNA, 1088 bp, Homo sapiens
tgaagacagcaaggattgtctttgggttgggaggagtgagaaacagatgatgggtagtggtagtggcttaataacggccatatttgctaaacaggatctagattcttgtcacttaaaaaagtgcgggaaggactggccaagtggaagtctaccacgcgatgctcgtggactgactgaggagtacccagcccggagcgcgctcagcctgtggccggcctcctcaccaaggggtaggcaggtgcccagaatgctggaggatgcccggcgcccacccatccccgggtaccgacctgagcctcccgtaccttacctcactcaacagcaggctgcagccgctccgctttacggcactcacagcaaccgccgcaaaagccgccgtcaagtgctgagcggcggaggctggcttggttcctgctgggacgttcccacggtccagccccagcctcggctttcctgtgactcttgtcgcatcctcaccgccagaagttcactgagccctggcgattcctcgcttttataatctagccacttagccaaagcccttttttatctcttgcctaattgacaactacagcagcgcactgaggcaatctgagagtttaagttctgaaacgctttcgacagcggaagatgaactggaggcagcagctgagccgttttccaagcccgttaaatgtgaacttctgataaacgagtggtttttttaaaatttcctatgcacatacaagcttactgttgaagtcctctcatccaatgcactcagaacgggactgtaagtccagctgctgtgtatcatcacctcagcccgattggtcctcggccacacttcacttcagcttctgataggtcctgggccaagctaagcagcatctatgaatcatttcacctcctgactggtcccgggccaagccgagtcacgcattcgccaagacagcccccagactaagcacattccttccccttccgtccataaaaacctggaccccagcctcatgatgggcactcccgttcgggaccccctctctgctggcagagagctttcttctttcaccttattaaactttcactctaacctcacctttgtgtcc

SEQ ID NO: 466092 - DNA, 823 bp, Homo sapiens
tgaagacagcaaggattgtctttgggttgggaggagtgagaaacagatgatgggtagtggtagtggcttaataacggccatatttgctaaacaggatctagattcttgtcacttaaaaaagtgcgggaaggactggccaagtggaagtctaccacgcgatgctcgtggactgactgaggagtacccagcccggagcgcgctcagcctgtggccggcctcctcaccaaggggtaggcaggtgcccagaatgctggaggatgcccggcgcccacccatccccgggtaccgacctgagcctcccgtaccttacctcactcaacagcaggctgcagccgctccgctttacggcactcacagcaaccgccgcaaaagccgccgtcaagtgctgagcggcggaggctggcttggttcctgctgggacgttcccacggtccagccccagcctcggctttcctgtgactcttgtcgcatcctcaccgccagaagttcactgagccctggcgattcctcgcttttataatctagccacttagccaaagcccttttttatctcttgcctaattgacaactacagcagcgcactgaggcaatctgagagtttaagttctgaaacgctttcgacagcggaagatgaactggaggcagcagctgagccgttttccaagcccgttaaatgtgaacttctgataaacgagtggtttttttaaaatttcctatgcacatacaagcttactgttgaagtcctctcatccaatgcactcagaacggcttaagcctgccacaggggcctatcatgcatgcatgtggacaactcagtctgcac

SEQ ID NO: 466093 - DNA, 3965 bp, Homo sapiens
gtaccagcagctggaggatttgtttggtagcacctgggggatggctctgtcccgggcgcacttaggcgggctgtgcggagcgctttaccttccacagtgtccggcacacgcatccttttcgacatcatcacttgacctgctgcaataggtaacctacctggctctctcgcatcccgttatcagcgtcaagaagatttgcacgtaggcctttaaagccagccaccagccccgggcgccttcctctcactaaccccatgctgcctttccaaacggaagatgaacttagcaattctaggcgctgcctgtgtactagacaagtcttgctgtgttgcccaggccggagtgcagtggtgcaatctctgctcagtgcaacctctgcctcctgggttcaagtgatcattctgcctcaggctcctgactaattgggattacaggcatgcaccaccacaccagctaatgtttgtattttcagtggagacggggttttaccatgttggccaggctggtctcaaactcctgacctcaggtgattcgcctgcctcggcctcccaaagtgctgggtttacaggcgtgagccaccgcccggcctcatgtcatcaaaagaagagaaaacagaggcacaagagaagatgaccacagaagacagaggcagaggctggggttatgctaccacaaaccggagaatgccaaggattgctggcaaccaccaggagcctggggagaggcgtggaacccctcctccctcagaggccccagaaggatccaaccctgctaataccttgattttagacttcccacccccagaactgtgagaaaataaatttctagctgctttaagccatctagtgtgtggtactttgtttgttacaacagccctaggacactaatgcagcttgagtcagttactttgtcaccaggttggtggcagctgttagctctcaacagaggccagtttcttccccacgaaagcaggcagcatgctcctagggcaaccatactctcccctcagagcaaaagaagtagtaaatgcatgcttgacagtggacttgtgggtttgcaacaggttatgattagcaacttgatcacaactatatttaagattcttgtaattgggattggtctgtacagcattctaagttttgataaacagctttggaaatttatatggaagacaattaacattttcttgtatcaacatggacttgtgacttccataaacttaattttcattgtttcctttgatgataacttgtcaaagacagagtacccatacttattccaaaatagaagtcttgatgaataggcacatttgcaaattgtagggaattcacgcacatcacaggaagtctcaaaattaaaatccttctgatacggtttggctgtgtccccagccaaatctcatcttgaattgtagttcccataatccccacgtgtcatgggagagacccagtgggagggacctggtgggaggtaattgaatcatgggggctgttagccccatgctgttctaatgatagaaaaccagagacctttgttcacttgtttatctgctgaccttccctccactattgtcctatgaccctgccaaatccccctctccgagaaacacccaagaatgatcaataaaataaataaataaataaataaataaataaaaagaaaaacatcatccaaagagcacaagagaattgtaactcacattgtgcaattttaccattgtcctcatattcaggatcaaggatacagattgatggagaaaaggtagtgtctcactggattaattcattgttggatgggaaaggacgaaatttctcttaatgacttcactattgctagaggttttactgatgtacagaagagttaacatagcaagcctgattgcgatgttggccttgggctggtgtctgggaacttggatttgaagcgtgtccccaccattccctaactgacaagggtggcccattctgcctagactatacaaacagtgtggtttatgctgaacacctgccttcctttggggggtctggaattttggtacacgctaggcagagggtgccttatgtgactagaccctagtaaaactttggatgttgagactctaatgggtttccctctaataagcagaaacattgaatgcttactgctggggaaatatattttcattgctgaaggaagagtgcactgtgcaattcctcgtggagggagggggcagtaggatgcctgcccatggatttccccaggctccacctgagtctttctccctcctcattacattgccgtaataaaccttagccatgaatacaactatagtctgggtcccgtgagcccttccagtgactctccaaacataaggtaagtaatccaaatcagcaggtcctactcacccttacccttcccacataattcacaaaccaaggtaataagacctcaaataaggaatgacgcctgtttcacagttcagcatgaccaacagctgatatctaaacaatgcccccaagctggcaagtaaaacccaaacataacccaaagccatctgtgggtggctcctctgcccttccgaggtctgattaaattggaacaaatccaagttctatgttccatgatagtccaaagttctcccacaatgcctgtgagctccctgggcttgcctcctcctgcgtcctgctagctatttttaaatgtgagctctattttgttccaagatcattaggatatttagccccttcaccaatttccacaagaaaattaattcattccaatattcagaggttccttttttatttcttagccagtgattaaggaatccattatgtaacccagagccattctctctactcttttcttaatttttccttctaaaatggggagttccattttcttaatttttcattctaaattggggagttccaaattttttttctctctctctcttaggcaaagcagttcatgtccttcctggaagttttagtatctgccagtactgatgcccagtttgcattttaaaagctccttctagctgctagatgctgaaaagactgaaaggaggcaaggggataggcaaagggaccagtatcaggttattttaggagatgatggtggcttgaaccaggtagtggcaaagctcgtaaagacaagtgcatgaataggaatattttggaggagatgctgcagtacttgcttatagattggattgtaggtgaccagtttgaaattcagctaaaccagcagctatggtccctcatccccaacaacgatgtgagaaggcttgtttctcatgttatccggaccttgaagacggactgcactgagacccatttgcaactggcctgtgccaagctcatctctaggacaggcctcctaatgaagcttctcagtgagcagcaagaattgagaactgtatcaatgacagcatggaagcccagaatgaacagaaagagcagaagtcgaatgagggtgctacaataataaaatgctaattttattgccggtttttatgtgcagattgtcttagatttggccaatggaagctcctttaaggtggtttctgtgttccttttgacacatcccttactctttcgtgtttccatcatattttgcacactttcttactgactgacgcaaaaggatgtttcagggtttttttgtactttcgttgcccttgtctcagcccagccatccatcaagaggcagaagtcccaccacagaattacagcagacgctacccaagtggagacaggagggtagaaggagaggctggaaggggaagctaggatgagatgacattccaagacgtgcagcatgtttgcatgccagaaatgacatcgctgataggggtttacagaaatctcattagtaaccttccctaagtttgttcttacctacaaaaggaatctacttcacctgtactggaaagctgaaagtgcagggggccgaaggcccgtgggacatgaccaactcagcattcc

SEQ ID NO: 466094 - DNA, 599 bp, Homo sapiens
ccgcgacatgactctttctctctccaaacctgtttctgctggattgggcaggtctgataagcctggaacacttggcttccatgcgtgtctcagacagggaagcttctttggtctccttgtttcacctcatcggcctgggtaccggagggagggaggcgggcagaggaggggagatgggcacccccagtctttccatcctcctcattcgtctaggggcacccgaatcccctattccttatttcccctatcactcaggcactggcagggtcctttgcccactcctgttggccgctgcggctccaaagcgagctgggcagatgtgcctgacacaggtttgaccaggcaactgaaaagacatccctaagagaagacaaagcaaaggtatgaaaggaacacacgtccctgactgactaggaggaacagagctgcctgctatctggaacaacttcctcccagactaagtgagaaataaacttctgttttctatatgctactgtgtttgggggcctttgtgttatagaagttttgctgtcatcctttccaattcaccttctcacaccagatatttcaaattaaaaagattatatcaggccaggtgc

SEQ ID NO: 466095 - DNA, 1199 bp, Homo sapiens
gctttttatttgttttccctttaggtttttgtccctctcttaaagtgaatggtcacagagccatgagcaggtggaagatgcaggtggaggcatcttccctgtcaccgttggtatgtctggttgaaacctgcaacaagtgcggctgccgcctgggattccgggctgtgtcccttccctatctgtgctgggacagcatccttgcacagcctgactttgcagccaagtcctttaactacaaagagcctactggaaacagcttctccatggccgacttgcatcagccacacaagagcctctctgtgggcctggaacaggggcacctggaaacaaggccctgggaagccagagctgagctggagaaagacctgcccggggaggcacatttgaacctcagctatggcaatcccctgcccctctccctcagcatgttcccctcctgcctatgcccccaacctgtggtttggaaactgtcagcctcaacctagttgtggctaggaaaagtctggctaatagacacaaaaatggtttttaaaatattttaaagcatggggcttcctgttcccactccagctgttgggctgcctgggacacgttctctccccttctgcccctggtgtgccgtttgcatagcttgcgaggaagctggctgcctcaccctaatcttttattatgcagttgggttctctacctggctgacgccatgttgcctgcttcttcactgtgcatgtggagcctgaggggaatgtttcaaggaagaggggacaagcaagtcagcatctggaggaatggaggcagcactgtgttgcatggctccagagaacaccactctctttgtgttctatgcaacatgcccacgagttatgcattgcagcacctggccataaatcatcaccaaccctatggatgaagcaacaccccagggagggtggagaagtacaggggaaggagccagggcccccatgaaacaaacatttcttccaggaatttcccaagcccagaccattgcatgaaaagagaaataaaatactcttttgtttccatcacattgtttttggtctcagttggagcagcagaccctatattgcaacaaacagactcaatcaccctcattattaggaaagttggttaagatgctgaccccttattcccccagtgccatacctggctctgcaaagcacacaccactgtgggcatttagc

SEQ ID NO: 466096 - DNA, 1139 bp, Homo sapiens
cctcaatgggtgtgaagcgcagaatgggaaggcaaggaactaatgcaggtggtgactttaagttgaagccaacactcatttactatttccaaagtcccagggcagttaagaactctgctaaatcaactctgcctgtgctctgtaaatggaacaacgacacctggacggctgcatatctggtttacaccatggttcaaggggtacatgtgcaggtttattacatgggtaaattgcatgtcacaggggtttggtgtacagataattttgtcacccaggtggtcaagatattgatattctcagaagtttggaagaagttggttccaaccctcacaaatgactttgaaaggtttaacacttcagtggaagaagtcaccgcacatgtggtggaaacagcaagagaactagaattagaagtggtgcctcaagatgtgactgaattgccgcaatctcatgatcaaacttgaatggatgaggagttgcttcttatggatgagcaaagaaaatggcttcttgaaatggattctactcctggtgaagatgctgtgaacgttgttgaagtgacaacaaaggacttagaatattacataaatgtagttgataaagcagcagcagggtttgagaggactgactccaatttgaaagaagttctactgtgggtataatgctgtcaaacagcatcacattctatggagaagtcttttgtgaaaagaaaagtcaatcaatatgacaaagttcactgttgtcttattttgagaaattgccacagccaccccagccttcagcaatcatcaacatcaaagcaagaccctccattagcaacaagattatggctcgctgaaggctcagatgatcattagcattttttagaaataaagtatttttaaattaaggagaggtgcccgatgagctcccagtcatgtggttcagggcgggctctggaagactcacagaggagactcctccgagaaaccaagaaggtttctgtccaagtcgggatctgctctgctcaggatgctcctccaacacacacagtgaaaaactgagcacctagagagcaacaccaaaaacccatggccaataatggagagccaaatcaggagagcattcagcaaagcaattcttgctgtagaaggaacagc

SEQ ID NO: 466097 - DNA, 1564 bp, Homo sapiens
tactttggaagccgattgaggcaagatttctgagacaagttctgaggtttccaagacagactttagcttttctaaatcattttttaagtgctatgtaaaggattacagcattcaattctccagtagtccaacagcatcatggtggagcaagagggattatcctgtgggcatcctccggaaaactgtatatacccaaaaggattgaagatcggtatacatggatatgcatacaccattcacaacggctaaaaggtagaaacaacccaatgtccatgaatggatgaatggataaacaagttgtgtgatatatcaatacagcagactattactcagccataaaaaggaatgaagttctgataaatgtgaccatgtggatgaaccttgaaaatattatgttaagtgaaagaagccagacaaaaggtcaaatattattattattccatttatatgaaatatccagaataggcaaatccatagagacagaaagcagattggtggttgccaggggctaagggagtagagaatggggagtgactgcttcatggtacagggcttccttttggggtggtgaaaatgctctgcaactagacagtagtgacggttgcacaacattgtaaatgtactaaatgtcacaaattgttctgtttaagtggttaattctatgttattgaatttcaccttaattttaaaaagagaaagaaagaaaaagaggaagcagaaggctctaaagagaatgtatgtccagagagccctgagcagccccaccaccaccgctggcctagctaccatcacaccccgggaggagccgcagctgccgcagccggccccagtcaccatcaccacaaccttgagcagcgaggccgagacccagcagccgcccgccgcttgccgctcgccgccccccgccctcagcgccggtgacaccacgcccggcactacgggcagcggcacaggaaacggtggcccgggaggcttcacatcagcagcacctgccggcggggacaagaaggtcatcgcaacgaaggttttgggaacagtaaaatggttcaacttaaggaacggatatgctttcatcaacaggaatgacatcaaggaagatacatttgtaccccagactgccaaaacgaagaataaccccaggagatgctatccacgtcgtaggggtcctccacccaattaccagcaaaactaccagaatagcgagagtgggggaaagaacgagggatgggagcgtgctccccaaggccaggctcaaccacgccggccctacagcagggatatagaccacgattccgcaggggccctcctcgccaaagacagcctagagaggacggcaatgaagaggataaagaaaatcaacgaggtgagacccaaggtcagcagccacctcaacgtcggtaccgccgcaacttaccgacgcagacacacagaaaaccctaaaccggccagaaaagaaaaccctaaaccacaaggtggcaaagagacaaaagcagccgatccaccagctgataattgagaattagtccgctcccgaggctaagcagggcggggctgagtaaattcc

SEQ ID NO: 466098 - DNA, 2642 bp, Homo sapiens
agcagcagcatttggcgtagaaggaggggaacaacaggatataatgttgtgcacaaaagcacatgcacaattagtagtggtcactgccctgactctggcctccctggactcatacatgcctggatatggagagcctgtgctccacgtgatgtctgctactgggcttgcaatgtttcctccaagtatggtttgttacataggtatacgtgtgtcatggcggtttgctgcacctattgatgcatcctctaagttcctgcccctcatcccccaaccctcaacaggtcctggtgtgtgttgctctcctcgttgtgtccatgagttagttctcaatgttcagctcccacttatgacgacagggttgggaaaattccggttgctcttcttgtctgtgatatacggtagaagggttggtcctggtttggtccacctgccagcggagtttaaagtttccgaggctcagaggaacacaatgacttggatcaaacagcctaaatgggaagaaggacatttttgctgcatcaaggaagccgttaaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaagagagagaatgaggagatcttgatcatcttagtgtcggaggagtcgcagcggactgggaactgcagctgcgaccccccgcgtcctgtgcggatttcagggctgataccgcataggcggttatggaaaggacggtacaccggagcggcggaggatagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaagggacagggaccctgcggggggagcggtggtggtggcggcggcggcggcggctgcagtagcagcagcagctactgcagcttccctccctccttgtcgtcctcctcttcgtcctccccaacctctggctccccacgaggtagccactctagcgccctggagaggctagaaaccaagcttcacctcctcaggcaagagatggttggacaaaaatttaaggacaacccttaggtacataatggagaagctggaaagtggaagtcatcttgatgagtttgcaaaatagatgaaaagataaaatggaaaagatgacaaaccaacaggtcaggggatgcctgataccgtatcacaaagatcagacatacgtgtggagactaacaggtaaaactattttccacaagaaaatttattgcacaaggaattaagaatgttgctaactctgcaaattaaggacttaatatgagggacgaagacatcaaggagatgaggaaattttattcctaaccatgtcttctgtaattttgcccatggaatgttaatatattcacttaatctaataaataaatcttgttgaaacatattttctttctcagtagctcactgatagcacatcaaagataatactgtcattttgctggacactcagacacaatttagagtatttatatataacttgaaaacagtaacatttccaaaaaccgatgaaccccaccctgtcccaaggaatgattggtatgtatgtgaagatcattttctgacaaaaataattacgttccacttaggatgcacaaccatgttgtcctgtagagaagtcacaagttttgtgagaatttttaaactgatgatgtttatttccatggtaacaatttcaaaacattaaacatgttaaactgtatttttgtttaccataagccttcccaggaggaacaagcactaaacacagtctctggcttaggatttggatgaacatattcaaaagccatctgcttcccagcaatcataatcataccctttccttttggccactatcaccaagatctccagtagtacttcctctcagtccacaagaactgccatgagcagttaaaggttctcctgacacgaccagttcaagttttagagctcaataatattcatgatgtaggagtatcaagagcttttcattggtagcattttagttccccaagagattctgttcaggataaaacttagaccttaggggaaagaaaagctgtcctcctgtagatgcgaatggctctttcaataatcaccttcagtttccttgaacattttttgtttttgttaacaagtatttaactacttactctatttgttccttttattcaaactacaaagcaatgtactggt

SEQ ID NO: 466099 - DNA, 2611 bp, Homo sapiens
agcagcagcatttggcgtagaaggaggggaacaacaggatataatgttgtgcacaaaagcacatgcacaattagtagtggtcactgccctgactctggcctccctggactcatacatgcctggatatggagagcctgtgctccacgtgatgtctgctactgggcttgcaatgtttcctccaagtatggtttgttacataggtatacgtgtgtcatggcggtttgctgcacctattgatgcatcctctaagttcctgcccctcatcccccaaccctcaacaggtcctggtgtgtgttgctctcctcgttgtgtccatgagttagttctcaatgttcagctcccacttatgacgacagggttgggaaaattccggttgctcttcttgtctgtgatatacggtagaagggttggtcctggtttggtccacctgccagcggagtttaaagtttccgaggctcagaggaacacaatgacttggatcaaacagcctaaatgggaagaaggacatttttgctgcatcaaggaagccgttaaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaggactgggaactgcagctgcgaccccccgcgtcctgtgcggatttcagggctgataccgcataggcggttatggaaaggacggtacaccggagcggcggaggatagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaagggacagggaccctgcggggggagcggtggtggtggcggcggcggcggcggctgcagtagcagcagcagctactgcagcttccctccctccttgtcgtcctcctcttcgtcctccccaacctctggctccccacgaggtagccactctagcgccctggagaggctagaaaccaagcttcacctcctcaggcaagagatggttaacctcagagccacagacgtcaggctcatgcgccagttgcttgtaatcaatgagagcatcgagtccatcaagtggatgatcgaagaaaaagccaccattaccagcagaggcagcagcctcagtggcagcctgtgcagtttgttggagagtcagagcacctccttacgtggcagctacaacagcctacacgatggcagtgatgggctggatggcatttccgtgggaagttatctggacacgttggcggatgatgtcccaggccatcagaccccttcagacttggaccaattcagtgacagctccctcatagaggactcacaggcactacacaagcgtcctaaattggattctgaatactactgctttggctagtgacagttttttgcatgggactggtgtgcaatgaacttgtatttatccttcttctccgctgctatatttttggtgtgatttttattttaataagatgacctttttaaaagaagctgattttgaaactgcttaatggtattgctgttgctcctaatacttctcatctgagctgatttatttttctctgttacatctctattttttatttattacaatgattttctcccttcttttacagtagcacaaacaaagtagggggaaaagaataagcaataattatgtttttgcttttgttttcagagcaatgggtcagggattacaagaaaaactttgctaaattttacaataaaccaaagtctgataacaaaaaaaaaagctgcttgcgtccttaaatgacttaaggtttcatcttccagaagatattgagatatattactgtttgcatatcaggttgaacaaaatgcttggaacaaaattaagcattatttctagaccacaacattctagtgtataatcaaccatactgttagtcacacacgcccacatgacaatcatctgaaagtccccaactatacacattctgttcaaccaactcacccttgtgttggtactttagattaacattttgtcatcagtgattctaactcaaatcatatgtttatttgtgtaataaaatgtattattctcccaaatttcaaggaataattgagattaagtatggaggccattcaaggcaaaaatgtcctaaatttaattgcattttgagattttgttggcatttacttgtatgtattttgtgattctgataggatgta

SEQ ID NO: 466100 - DNA, 1245 bp, Homo sapiens
ggcctttcgagagtgtaaaatggctggaatatctttcttctctctttgtccataggttaacctcagagccacagacgtcaggctcatgcgccagttgcttgtaatcaatgagagcatcgagtccatcaagtggatgatcgaagaaaaagccaccattaccagcagaggcagcagcctcagtggcagcctgtgcagtttgttggagagtcagagcacctccttacgtggcagctacaacagcctacacgatggcagtgatgggctggatggcatttccgtgggaagttatctggacacgttggcggatgatgtcccaggccatcagaccccttcagacttggaccaattcagtgacagctccctcatagaggactcacaggcactacacaagcgtcctaaattggattctgaatactactgctttggctagtgacagttttttgcatgggactggtgtgcaatgaacttgtatttatccttcttctccgctgctatatttttggtgtgatttttattttaataagatgacctttttaaaagaagctgattttgaaactgcttaatggtattgctgttgctcctaatacttctcatctgagctgatttatttttctctgttacatctctattttttatttattacaatgattttctcccttcttttacagtagcacaaacaaagtagggggaaaagaataagcaataattatgtttttgcttttgttttcagagcaatgggtcagggattacaagaaaaactttgctaaattttacaataaaccaaagtctgataacaaaaaaaaaagctgcttgcgtccttaaatgacttaaggtttcatcttccagaagatattgagatatattactgtttgcatatcaggttgaacaaaatgcttggaacaaaattaagcattatttctagaccacaacattctagtgtataatcaaccatactgttagtcacacacgcccacatgacaatcatctgaaagtccccaactatacacattctgttcaaccaactcacccttgtgttggtactttagattaacattttgtcatcagtgattctaactcaaatcatatgtttatttgtgtaataaaatgtattattctcccaaatttcaaggaataattgagattaagtatggaggccattcaaggcaaaaatgtcctaaatttaattgcattttgagattttgttggcatttacttgtatgtattttgtgattctgataggatgta

SEQ ID NO: 466101 - DNA, 1396 bp, Homo sapiens
accacaaagcaacagcattttctactagcttggagataaggaaagttgcaccagtgggcctcaaaaagagaaaataatttcattaaattaacttcacagttgcttttgatttgcttcaaagtaggctaggagatttctatcactccgacaggaatgatggaaattatttctatcattctatcgtttagttattatagagttctatcatttagtgattgttattttttaggttggacaaaaatttaaggacaacccttaggtacataatggagaagctggaaagtggaagtcatcttgatgagtttgcaaaatagatgaaaagataaaatggaaaagatgacaaaccaacaggtcaggggatgcctgataccgtatcacaaagatcagacatacgtgtggagactaacaggtaaaactattttccacaagaaaatttattgcacaaggaattaagaatgttgctaactctgcaaattaaggacttaatatgagggacgaagacatcaaggagatgaggaaattttattcctaaccatgtcttctgtaattttgcccatggaatgttaatatattcacttaatctaataaataaatcttgttgaaacatattttctttctcagtagctcactgatagcacatcaaagataatactgtcattttgctggacactcagacacaatttagagtatttatatataacttgaaaacagtaacatttccaaaaaccgatgaaccccaccctgtcccaaggaatgattggtatgtatgtgaagatcattttctgacaaaaataattacgttccacttaggatgcacaaccatgttgtcctgtagagaagtcacaagttttgtgagaatttttaaactgatgatgtttatttccatggtaacaatttcaaaacattaaacatgttaaactgtatttttgtttaccataagccttcccaggaggaacaagcactaaacacagtctctggcttaggatttggatgaacatattcaaaagccatctgcttcccagcaatcataatcataccctttccttttggccactatcaccaagatctccagtagtacttcctctcagtccacaagaactgccatgagcagttaaaggttctcctgacacgaccagttcaagttttagagctcaataatattcatgatgtaggagtatcaagagcttttcattggtagcattttagttccccaagagattctgttcaggataaaacttagaccttaggggaaagaaaagctgtcctcctgtagatgcgaatggctctttcaataatcaccttcagtttccttgaacattttttgtttttgttaacaagtatttaactacttactctatttgttccttttattcaaactacaaagcaatgtactggt

SEQ ID NO: 466102 - DNA, 2665 bp, Homo sapiens
agcagcagcatttggcgtagaaggaggggaacaacaggatataatgttgtgcacaaaagcacatgcacaattagtagtggtcactgccctgactctggcctccctggactcatacatgcctggatatggagagcctgtgctccacgtgatgtctgctactgggcttgcaatgtttcctccaagtatggtttgttacataggtatacgtgtgtcatggcggtttgctgcacctattgatgcatcctctaagttcctgcccctcatcccccaaccctcaacaggtcctggtgtgtgttgctctcctcgttgtgtccatgagttagttctcaatgttcagctcccacttatgacgacagggttgggaaaattccggttgctcttcttgtctgtgatatacggtagaagggttggtcctggtttggtccacctgccagcggagtttaaagtttccgaggctcagaggaacacaatgacttggatcaaacagcctaaatgggaagaaggacatttttgctgcatcaaggaagccgttaaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaagagagagaatgaggagatcttgatcatcttagtgtcggaggagtcgcagcggactgggaactgcagctgcgaccccccgcgtcctgtgcggatttcagggctgataccgcataggcggttatggaaaggacggtacaccggagcggcggaggatagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaagggacagggaccctgcggggggagcggtggtggtggcggcggcggcggcggctgcagtagcagcagcagctactgcagcttccctccctccttgtcgtcctcctcttcgtcctccccaacctctggctccccacgaggtagccactctagcgccctggagaggctagaaaccaagcttcacctcctcaggcaagagatggttaacctcagagccacagacgtcaggctcatgcgccagttgcttgtaatcaatgagagcatcgagtccatcaagtggatgatcgaagaaaaagccaccattaccagcagaggcagcagcctcagtggcagcctgtgcagtttgttggagagtcagagcacctccttacgtggcagctacaacagcctacacgatggcagtgatgggctggatggcatttccgtgggaagttatctggacacgttggcggatgatgtcccaggccatcagaccccttcagacttggaccaattcagtgacagctccctcatagaggactcacaggcactacacaagcgtcctaaattggattctgaatactactgctttggctagtgacagttttttgcatgggactggtgtgcaatgaacttgtatttatccttcttctccgctgctatatttttggtgtgatttttattttaataagatgacctttttaaaagaagctgattttgaaactgcttaatggtattgctgttgctcctaatacttctcatctgagctgatttatttttctctgttacatctctattttttatttattacaatgattttctcccttcttttacagtagcacaaacaaagtagggggaaaagaataagcaataattatgtttttgcttttgttttcagagcaatgggtcagggattacaagaaaaactttgctaaattttacaataaaccaaagtctgataacaaaaaaaaaagctgcttgcgtccttaaatgacttaaggtttcatcttccagaagatattgagatatattactgtttgcatatcaggttgaacaaaatgcttggaacaaaattaagcattatttctagaccacaacattctagtgtataatcaaccatactgttagtcacacacgcccacatgacaatcatctgaaagtccccaactatacacattctgttcaaccaactcacccttgtgttggtactttagattaacattttgtcatcagtgattctaactcaaatcatatgtttatttgtgtaataaaatgtattattctcccaaatttcaaggaataattgagattaagtatggaggccattcaaggcaaaaatgtcctaaatttaattgcattttgagattttgttggcatttacttgtatgtattttgtgattctgataggatgta

SEQ ID NO: 466103 - DNA, 2611 bp, Homo sapiens
agcagcagcatttggcgtagaaggaggggaacaacaggatataatgttgtgcacaaaagcacatgcacaattagtagtggtcactgccctgactctggcctccctggactcatacatgcctggatatggagagcctgtgctccacgtgatgtctgctactgggcttgcaatgtttcctccaagtatggtttgttacataggtatacgtgtgtcatggcggtttgctgcacctattgatgcatcctctaagttcctgcccctcatcccccaaccctcaacaggtcctggtgtgtgttgctctcctcgttgtgtccatgagttagttctcaatgttcagctcccacttatgacgacagggttgggaaaattccggttgctcttcttgtctgtgatatacggtagaagggttggtcctggtttggtccacctgccagcggagtttaaagtttccgaggctcagaggaacacaatgacttggatcaaacagcctaaatgggaagaaggacatttttgctgcatcaaggaagccgttaaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaagagagagaatgaggagatcttgatcatcttagtgtcggaggagtcgcagcggactgggaactgcagctgcgaccccccgcgtcctgtgcggatttcagggctgataccgcataggcggttatggaaaggacggtacaccggagcggcggaggatagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaagggacagggaccctgcggggggagcggtggtggtggcggcggcggcggcggctgcagtagcagcagcagctactgcagcttccctccctccttgtcgtcctcctcttcgtcctccccaacctctggctccccacgaggtagccactctagcgccctggagaggctagaaaccaagcttcacctcctcaggcaagagatggttaacctcagagccacagacgtcaggctcatgcgccagttgcttgtaatcaatgagagcatcgagtccatcaagtggatgatcgaagaaaaagccaccattaccagcagaggcagcagcctcagtggcagcctgtgcagtttgttggagagtcagagcacctccttacgtggcagctacaacagcctacacgatggcagtgatgggctggatggcatttccgtgggaagttatctggacacgttggcggatgatgtcccaggccatcagaccccttcagacttggaccaattcagtgacagctccctcatagaggactcacaggcactacacaagcgtcctaaattggattctgaatactactgctttggctagtgacagttttttgcatgggactggtgtgcaatgaacttgtatttatccttcttctccgctgctatatttttggtgtgatttttattttaataagatgacctttttctcatctgagctgatttatttttctctgttacatctctattttttatttattacaatgattttctcccttcttttacagtagcacaaacaaagtagggggaaaagaataagcaataattatgtttttgcttttgttttcagagcaatgggtcagggattacaagaaaaactttgctaaattttacaataaaccaaagtctgataacaaaaaaaaaagctgcttgcgtccttaaatgacttaaggtttcatcttccagaagatattgagatatattactgtttgcatatcaggttgaacaaaatgcttggaacaaaattaagcattatttctagaccacaacattctagtgtataatcaaccatactgttagtcacacacgcccacatgacaatcatctgaaagtccccaactatacacattctgttcaaccaactcacccttgtgttggtactttagattaacattttgtcatcagtgattctaactcaaatcatatgtttatttgtgtaataaaatgtattattctcccaaatttcaaggaataattgagattaagtatggaggccattcaaggcaaaaatgtcctaaatttaattgcattttgagattttgttggcatttacttgtatgtattttgtgattctgataggatgta

SEQ ID NO: 466104 - DNA, 1004 bp, Homo sapiens
tatatctgacaagatggtattggcagggccggtttcttcaggagcctctctccttggcttaaccactcacctacccgctaaactacatccaagaagagtccaaaagaccctttaccaaggcagtgagaaatataattgtaaagggagtcacagcatcctgaaagggatcctcagtgaagctcttctctgtacaccagtaatgacagttagaacagttgcaacagaactaaagctcccagaatccaattggatgctgggttgcagggtggttagagctataggcaatcttacctatgttcaaactttgaagggtatttttagatctaagagatctgggtctttaaagtcagtcttggccagaatcaggctgcaaatgccaaagcaagagatgtcagcaatgagttgcaggtctttgccaaacagagcatcatctggcagtgaaaggagagcagaagaggggattttgaagtcttcctgcacacttccgacaacttgattgaactggacgcccttggaagttcatggcatcgcctataacagagtctgtgtaggcaaaaccccagcctatgctggaatttaactcttaaaaagcaacctaagtagaacacaagattgtaaactctaaggagattctaacaccaaaagaaagtatgacttgagccaatgaaatgccaaaatccagttctagctgacaacgtcagtagtggaggacagacttccacttgccatttgaggaaaaagcatgtggattcatgagcataacagcagataccccactaccaattaccaaatcctgtgcacattcctgttctccagtcaccttttctccataaatgtttgtggtataaaatgaaaaccttcccaaatattaaccagtcaacctttattctctgatttctttctctaaactagtgatgccttcattttcagtgtcactgacttgcacctaacagttcccagcttatgttgtaggtgctatctcatcttaaactgatcctgttctc

SEQ ID NO: 466105 - DNA, 1208 bp, Homo sapiens
tacgttctgtcctcctgcagccatctaaaatcagccagaaaggtttaggatcccatttcctgttcttgcatcggctgtccaagctgctgttcctctctccgcagtaagagggtgtttctctccctgttcaagaggagcaccaacacttgaggacagtatcatccctagaccttggcaagagagaccactgagtgaggcatccatggaacccaaggaagaggcctacgaagaacctgcagtcaccttctagaccattctccctcaccaaactgtcccctccagagagctgaggactggatcttcccatgctgacacctccagtgggaaagaaaattctagattcagctctgggtgtccaagtcattatgaaggcatatttgtcaaggtggaagaaaaggacatattctatttagcagtttgtaagtttgatcgataactttaaaatatttggacctatggtgtgggtgccacttgcctcttaatcagtgttgggcaggggccgaagggcaggcaggggggtgttgggcccaagggggccagctggatttggctcttgtctctgccccgggcctgactccctgctgccaatgcctgtggtctggatgcacttgctgcgaattgcccaggtggcagtggtggagcagagtctgctgggagacacagcaggaaacatacagcatcatggggtcccagaaagtgaaaatgcctgagaaggcgctgggagtgactggggacagccagatgaaggtccagttctggtgtcgggtccctgaggagggagctctgtggactggctccgtagcacatgctcctggggcttgcctggcaccggtgcagggatcaaggtgtgacaagcacaaggaagagagagcccggcaccacagcaggagggcccagcatcagagggaccgggggaagatccagaacctctgcggtagccacctcatccggtatacccgggctcccggggcactcacgggccagcgcttcctggggggtgtgttcacacttctcactgggggtcttgagtgtcactctttgacctctggtatctacacccacaagctcctttggctccttgtgtcactcatagctgactgagcagcaccctggggttccacatggaaatgggagacagttcctttgttttgagctttctgtttcaatgtctgctgtgccttctcacatccctgacttcaccacatgga

SEQ ID NO: 466106 - DNA, 462 bp, Homo sapiens
ctgtgcaggtgtgtggtgatctgctccttagagatatgtggaattttccggtaacgacgctaattagtatatcctcgtgtccaccaccacataggattccaaacatctggtttataatcctggctctgcactaaatggctatgtggcctcagttttctcacctgtaaaatcaagagcctggaacaagtacagttgactctgaacaagtcaggtttgaactgcatgggtccactcatatgaagatttctttcaacgaaagctaccccgagtgtgcctgcctttcctgcctccccttccacctcctgcacctctaccatccctgccacccctaagacagcaaggccagtctcttctctctccccctcctccttcagcctattcaacttgaagatgacaaggatgaagagctttatgatgatctacttccccttaatgaacagtaaatatattttttcttcctta

SEQ ID NO: 466107 - DNA, 1099 bp, Homo sapiens
cactacttataatgcctaatacaatatgaatgctcttcggggaggggggaagtatcgcaagaaaacaggaacactgaaagacatgggctccttctcagatcttagagaacaaaagaaagaactaaatggagatctctcctacaataaaccagggacggaacaaacaacagcagcagcggtcgcagggaaacagaatctgtgttggcgtgcagggagcaggcagcgtctgcaaagtagcgctggcaaccacaacagagaggccagcaacaggaggagcaggaggagccctggaacaagtacagttgactctgaacaagtcaggtttgaactgcatgggtccactcatatgaagatttctttcaacgaaagctaccccgagtgtgcctgcctttcctgcctccccttccacctcctgcacctctaccatccctgccacccctaagacagcaaggccagtctcttctctctccccctcctccttcagcctattcaacttgaagatgacaaggatgaagagctttatgatgatctacttccccttaatgaacagctggagtgcaatggtgtgatcttgtctcactgcaacttctgcctcccaggttcaagtgattctcctgcctcagcctcccaagtaactgtgatttcaggtgcccgccactacacccggctaatttttgtatttttagtagaggcggggttttgccatgttggccaggctggtctcaaaactcctgacctcaggagttcggcctccgaaagtgctgggattacaggcatgagccactgtgcccggcctagaaaactggtgtttccaacaagtcctttggtgctgctggtgctactgcgggccttctgaggagactttgagaaccgctgcatcaggattatcagcctggtaactcctggccgaagaaatgcacacccttcatttggctaaaagaaagaatttccaatattcataaagaaaacacaacttgtgggttctccaagcaggagaggaaaaatcatgttccagtctattcctgtaactaatgaagggctcaggtttcaaagtttacaccatagttttagggacacagaaatttaaaagcgaatgtcc

SEQ ID NO: 466108 - DNA, 372 bp, Homo sapiens
tgcttttccaaaataccttttttcagagtcatcaccatgaggggctgggacacgtgggcaatggagacttggctggagaggccagcctggaaggtctccaaaggagggccctacagatgtgtttcgaggaacaaagtgtccacaaacttcctgtgcctgccaggtagaagttatttgcacacacatccttcctccgcacaaattgtatccacccccatgcataattgtaggcctcctcctccacattgactgttaggaatcattaaaactgtccctgaaaacagaggtaatcttcacctgttgtgcagagggtaaagaaagtttttttccagtgctttttggggaattgttccgtgttccttactctagatg

SEQ ID NO: 466109 - DNA, 988 bp, Homo sapiens
  misc_feature (44)..(44): n is a, c, g, or t
cccaatctcactcctccccctctccccacaacccccgcccttanagcaacatgaggggctgggacacgtgggcaatggagacttggctggagaggccagcctggaaggtctccaaaggagggccctacagatgtgtttcgaggaacaaagtgtccacaaacttcctgtgcctgccaggaccgtcactcccaatgtgaagaaaagggggaaagacctggaaaagacatttgcagcaaaggaacagttttgttagggcctgtggcccgcaggttccagcgtggcagcctccgaatgagatttcccttctatgactttacccccaaaaaatcattgagagacacaagtaagtatgcggaacttcgtccagctggctgcttgggcagctgtagccacgttttctcttctcctggtgctcgctggctttgcttcctcctccatgtcttatccatcctatgtaaggtattgtgtttccaagatagaggagcctttgccccccaacaacgagttccaccctgcagaggcaacagcaaaggcacaaagacatgaagtcagttgcaggctctgcattgtgtttccttcctccaagccccagggaatggagcctccaccatttggtgtttggctagttacagcggcaagagtcagaagagcagctgagtcacacagtggttacaaaagttcccacccaacagtgacacaggtcacttccactcatcatccatcgacggtggaggacatgcccgacttcaaggagggaggggcaggaagaaggggaacggaaatgggtggtgatcaaccctgctgtgtttccaggaagagtgaatgagtgaagtcaccataggtgaagggggtggcaaggctctctaggaggagaaagcagcttagtcaaaagttgagagatgtaggtgaagatgagtattttcaggaaaagcagtgagtgactggctagaggagaatgtggggagtcagacacaagcttgggctcacc

SEQ ID NO: 466110 - DNA, 3633 bp, Homo sapiens
accacttccttaagcagctttccctgccaattccactcgcagcctgccagagcgcagctagagtttctgggcagaggagggagaagcaccccgcccatccccgccggcgcctcgcctacgtcactgcttcgagccgcagaccccctccctccttcccggtcgcggtagctttgacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagcagagtccatgccttttctcctggaatgtgcaagaattcgtggcccagagtatcttgcacagatgtggcaattcatatgtgaccccttaatcaaggctattggtactgaaccagatacagatgtgctctcagaaataatgaattcttttgcaaagtccattgaagttatgggagatggttgccttaatgatgaacacttggaagaactgggaggaatactgaaagcaaaacttgaagggcactttaaaaaccaagaattgagacaggtgaaaagacaggaagaaaactatgatcaacaggttgagatgtctctgcaagatgaggatgaatgtgatgtttatattctgaccaaagtatcagatattttgcactcattatttagtacttataaggaaaagattttaccatggtttgaacaactacttccattaattgtaaatctaatttgttcaagtaggccatggccagacagacagtggggattgtgcatatttgatgacatcatagagcactgcagtccaacttcatttaaatatgtagaatattttcggtggccaatgctactaaatatgcgagataacaaccctgaagtcaggcaagctgctgcttatggcctgggtgtcatggcacagtttggtggagatgattatcgttctttatgttcagaagctgttccacttctggtaaaagttattaagtgtgcaaattccaaaaccaaaaaaaatgtcattgctacagagaactgtatctcagcaatagggaagattttgaagtttaagcctaactgtgtaaatgtagatgaagttcttccacactggttatcatggcttccactgcatgaagataaagaggaagctattcagactttgagttttctctgtgacctaattgaaagtaaccacccagttgtaattggtccaaataattccaatcttcccaaaataatcagtataattgcagaaggaaaaattaatgagactattaactatgaggatccttgtgccaaacgcctagctaatgtcgtgcgtcaggtacagacttctgaagatttatggttggaatgtgtatcacaacttgatgatgaacagcaggaagccttacaggagttgctaaattttgcttgaagcactttaatataacttgaatattatctattataaaagtaactacaaataagtgttgtgaatagattttattataaatcagagaactgttttctccctgctaagcagtttatagttcttctccatgtttctccagaattaatcagtgttagtcctctgtttatctcgcatgttttatcttccaaacacagaccttggtgataacctgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaaaaataagatagaatttccaggacaaacatctttggaattgtgagtgaaggatatagtggcaggcttgtccctctttaattaatactcttggtatttgtggtgatgggaggatgctgttactaggagagttttgagatactgcagtggatgtgggatgtatatgaacttcttcataatgtactcctgggaactgggtaggacatatccatattgtagttcccaaggtgtctggttgagagttagagaacttttaaatttctttagccagacaggtctctatttttttaagttatccaggactccaagaaccatagttactgaaaagggagtcctgatacatctaatattggtagcatgtaacagtgtttgacaaagagtaagtaagcagtattcttgggagtcagtgttatgtgtttcagcagagtattattttgtatatgtatgccattttctccctgcaaagcagctcaacaagagaaaaagctctagttatagggcttaaattgatttctatttcaaataatttcctaagagattctagagtagaactgaagagtattctattggaaaagtgaaaggaaagaaatgtaattttctttgaacatgaaaaagaaaacaactttgagagtagtcatttagcagtagatgtgcattattatgagaaaacagttctataagtccagggttaattatattaattggaatgtcagtctttaatgtcgagcttattgtagggtagaaaagagctttctactcagctaacgattactcattgatccaaaacttaaatacatctataatttcctggggctattgtgagtactgtgtatgtatttagcaaatatttaagacctagtaagtgctcaataaattgtagctgtta

SEQ ID NO: 466111 - DNA, 490 bp, Homo sapiens
tgtttcagcagagtattattttgtatatgtatgccattttctccctgcaaagcagctcaacaagagaaaaagctctagttatagggcttaaattgatttctatttcaaataatttcctaagagattctagagtagaactgaagagtattctattggaaaagtgaaaggaaagaaatgtaattttctttgaacatgaaaaagaaaacaactttgagagtagtcatttagcagtagatgtgcattattatgagaaaacagttctataagtccagggttaattatattaattggaatgtcagtctttaatgtcgagcttattgtagggtagaaaagagctttctactcagctaacgattactcattgatccaaaacttaaatacatctataatttcctggggctattgtgagtactgtgtatgtatttagcaaatatttaagacctagtaagtgctcaataaattgtagctgttattgctgttgttgtttgta

SEQ ID NO: 466112 - DNA, 3718 bp, Homo sapiens
accacttccttaagcagctttccctgccaattccactcgcagcctgccagagcgcagctagagtttctgggcagaggagggagaagcaccccgcccatccccgccggcgcctcgcctacgtcactgcttcgagccgcagaccccctccctccttcccggtcgcggtagctttgacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagcagagtccatgccttttctcctggaatgtgcaagaattcgtggcccagagtatcttgcacagatgtggcaattcatatgtgaccccttaatcaaggctattggtactgaaccagatacagatgtgctctcagaaataatgaattcttttgcaaagtccattgaagttatgggagatggttgccttaatgatgaacacttggaagaactgggaggaatactgaaagcaaaacttgaagggcactttaaaaaccaagaattgagacaggtgaaaagacaggaagaaaactatgatcaacaggttgagatgtctctgcaagatgaggatgaatgtgatgtttatattctgaccaaagtatcagatattttgcactcattatttagtacttataaggaaaagattttaccatggtttgaacaactacttccattaattgtaaatctaatttgttcaagtaggccatggccagacagacagtggggattgtgcatatttgatgacatcatagagcactgcagtccaacttcatttaaatatgtagaatattttcggtggccaatgctactaaatatgcgagataacaaccctgaagtcaggcaagctgctgcttatggcctgggtgtcatggcacagtttggtggagatgattatcgttctttatgttcagaagctgttccacttctggtaaaagttattaagtgtgcaaattccaaaaccaaaaaaaatgtcattgctacagagaactgtatctcagcaatagggaagattttgaagtttaagcctaactgtgtaaatgtagatgaagttcttccacactggttatcatggcttccactgcatgaagataaagaggaagctattcagactttgagttttctctgtgacctaattgaaagtaaccacccagttgtaattggtccaaataattccaatcttcccaaaataatcagtataattgcagaaggaaaaattaatgagactattaactatgaggatccttgtgccaaacgcctagctaatgtcgtgcgtcaggtacagacttctgaagatttatggttggaatgtgtatcacaacttgatgatgaacagcaggaagccttacaggagttgctaaattttgcttgaagcactttaatataacttgaatattatctattataaaagtaactacaaataagtgttgtgaatagattttattataaatcagagaactgttttctccctgctaagcagtttatagttcttctccatgtttctccagaattaatcagtgttagtcctctgtttatctcgcatgttttatcttccaaacacagaccttggtgataacctgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaaaaataagatagaatttccaggacaaacatctttggaattgtgagtgaaggatatagtggcaggcttgtccctctttaattaatactcttggtatttgtggtgatgggaggatgctgttactaggagagttttgagatactgcagtggatgtgggatgtatatgaacttcttcataatgtactcctgggaactgggtaggacatatccatattgtagttcccaaggtgtctggttgagagttagagaacttttaaatttctttagccagacaggtctctatttttttaagttatccaggactccaagaaccatagttactgaaaagggagtcctgatacatctaatattggtagcatgtaacagtgtttgacaaagagtaagtaagcagtattcttgggagtcagtgttatgtgtttcagcagagtattattttgtatatgtatgccattttctccctgcaaagcagctcaacaagagaaaaagctctagttatagggcttaaattgatttctatttcaaataatttcctaagagattctagagtagaactgaagagtattctattggaaaagtgaaaggaaagaaatgtaattttctttgaacatgaaaaagaaaacaactttgagagtagtcatttagcagtagatgtgcattattatgagaaaacagttctataagtccagggttaattatattaattggaatgtcagtctttaatgtcgagcttattgtagggtagaaaagagctttctactcagctaacgattactcattgatccaaaacttaaatacatctataatttcctggggctattgtgagtactgtgtatgtatttagcaaatatttaagacctagtaagtgctcaataaattgtagctgttattgctgttgttgtttgtacctctattgtgtctggaacttcttttactttagaattttcccaatccattccctactcattcatatt

SEQ ID NO: 466113 - DNA, 588 bp, Homo sapiens
atggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggtctgtgtaagactaccttcctcttagatgccgtcagaaatagaagagcaggttatgaggtgagacaaatggctgccgcactgctacgacggcttttgtcctctgggtttgaggaggtttatccaaatctgcctgctgatgttcagagagatgtcaagattgaactgattctggctgttaagttagaaacacatgctagcatgaggaaaaaactttgtgatatttttgcagtgctggccaggaatttgatagatgaggatggcactaaccactggccggaaggtctgaagtttcttattgattcaatctactccaaaaatgtggttctatgggaagttgcacttcacgttttctggcactttcctgggatttttgggacccaagagcggcatgatttggatatcatcaaacggttgttggaccagtgtattcaagatcaagaacatccagca

SEQ ID NO: 466114 - DNA, 1409 bp, Homo sapiens
  misc_feature (3)..(4): n is a, c, g, or t
  misc_feature (6)..(8): n is a, c, g, or t
  misc_feature (12)..(12): n is a, c, g, or t
  misc_feature (15)..(16): n is a, c, g, or t
agnnannngatntcnnagaaagtgtctagtgtgtgttggtgtaagacacctggtatctttaggcagcatgagtcctttgtaattactacaggttctgcaaagaactattactcttggcaaggactttattgacattccctttagcaaacagagactcggtgatgttcacggccaccagctctcaggaaaggctgttgtgggcagcaacacagctggacattcctttgcttactgatgggagattcataaggatacttgctcttggagcccacctgccctgctgggaggtgctgggaacacctggagagccatgtgcagctgtgtggccagcaatcccagctttgttcccagccagctgccagacctgggagtgaggaagccttccagaagaccccagcctagtccccatctgacagcgacctcatgagatatcctgagtgagatctacccagccgagcccaataaacccatgaaaacatcagagtgcacaggtgatgaatcctgttgggactgggcccttcccttcaagacagtgggctctcttctggcccaacatgtgtctagaaatgttcaggagctagagcctggaatggaggcctcaggactctgcctggtgccctatcatattatggctgagctggcatccaagttgcaagacaaagttctctttactcttccctcttctctcctcaagcagagtaaaggaatatctcccagagctgcgagctgtactgcctggagcattctctttgcctctccagctggtgtctcactacatcatgtgcccccaagtccactggctctgaacccagcacagtatcaggacttgcccaggaattatagtccttatggcctagattgccttgcaagtttatttaggacccagagaactttagtccacagaggacacaaaagaagctttcaggtcatttatgtggctcttgagctagcaatttgaatttctaagatgcatcattctctttcgccactttgtccagcaacattaggagtaaacagccaactcattatattaataagatatgcaaaaatgttcagaagtattacatacacagttacccagctccttgttttttataagtggtcgattaggagtattcaatagaggtatttagtgtatctctattgacagatcacatcgtagactatcagtgttctccttagtactgaaaatagagtcattactgtctatacatctaatcagtatattcattttctaggtggtagaaatttgatctccactgtcagtacatctgagtaatattctgttattaaatgaatggattattatttatatcattgcaatgtcttcaccaagttgtcactttattaaaattaggattcttggtggtagccaaaggcttgcttttgacacaggttggttgctagga

SEQ ID NO: 466115 - DNA, 2720 bp, Homo sapiens
tcaaaagccctggagggtcggacatgagactggcatctgaagtggagatccagtctctcaagattctactgtttcccaagaggagaactcaaaagaggataaaatggtcactgtttgtcccaatactgagtcctgtggccgtaagacaaggaactgtggcagccaccagaagcaggaagaggcaaggaacagattatcccccagagcctctgaagggagcacagccctgccaacacctagatctcagacttctggcctccagaactgtgagagaacaaattcctattttgagtcaccaaggttatgggaatttgttacagctcccagaggaagatgaatcagctttagataaaataatagaaaggtgcctcagggatgatgatcatggcttgatggaagaatcccagcaatattgtggcagctcagaggaggatcacggtaatcagggaaattcaaaaggaagagtcgcacaaaacaaaactcttgggagtggcagtaggggtaagaaatttgacccagataaaagcccctttggacataatttcaaagaaacttcagacttaattaaacatctgagagtctacttgaggaagaaatctcggaggtataatgaaagcaagaaacccttcagttttcattcagaccttgttctgaaccgcaaggagaaaaccgccggagaaaagtcacggaaatctaatgatggtgggaaagtcctgagtcactcttcagctcttactgaacatcagaaacgtcagaagattcatttgggggataggtcccaaaaatgcagtaagtgtgggataatctttattagaagatcaactctttctaggagaaaaacccctatgtgtgagaaatgtcggaaagattcatgtcaagaagcagccttaaataaagatgagggaaatgagagtggagaaaaaactcataaatgtagtaagtgtggaaaagcctttggctatagcgcctcactcaccaaacatcggagaattcacactggagaaaaaccctatatgtgtaatgaatgtggaaaagcttttagtgatagttcatcgctcacaccacatcatagaactcatagtggagagaaacccttcaaatgtgatgactgtgggaaaggtttcaccctaagtgctcacctcattaaacatcagagaattcatactggagaaaaaccttataaatgtaaagactgtgggagaccctttagtgacagttcatctcttattcaacatcagcgaattcatactggagaaaaaccctatacatgtagcaattgtggaaaatccttcagtcatagctcatccctttccaaacatcagagaattcatactggagagaaaccctataaatgtggcgaatgtggaaaagcctttaggcagaattcatgccttacccggcatcagagaattcacactggagaaaaaccatatttgtgtaatgattgcggaatgacttttagccattttacgtctgtgatttatcatcaaagacttcattcaggagaaaaaccctacaaatgtaaccagtgtgagaaagccttcccaacccattcactgctaagtcgtcatcagagaattcatactggtgtaaaaccttataaatgtaaagaatgtgggaagtccttcagtcagagttcatctcttaatgagcaccaccgaattcatacaggagagaaaccctatgagtgtaactattgtggtgcaacctttagtcgaagctcaatccttgtagaacacctaaaaattcataccggaaggagagaatatgaatgtaacgaatgtgagaagacatttaaaagtaattcaggcctcattagacatcggggatttcactctgcagagtaatcctggaactacattaaagtggggggaatttaattcaaattgtcagttactgaaaccctgggatgtaaacttacagtattgatcagtagctgcagctttcgtaaattggcagttaggaaaaatatccttttgcccattcatccctcttcttttcaaggatggcaacgactggtaaacagtaattagttggtaaagtcactggaaagggaagaatgcaaaatgattctgaggccagacgaattggaaaagctcttttcttcaggggatttctctctgatttcttctactaccatgtagtgtgatggagagaacttgactgcagtcacataacttggattctgtcccagtttgccaaccaacttgctgtatacaccttggacaagtcatttgacctttcagaattttattttcgtcaccagcagaatgaagggatgggattaatgatttttgccttttttggttttttagttttttattggtatcctgataatctctgaagctgtggacataagttatttttttttatttgtcattactttcaagtttctctagtaaaaaatacaataccactattcaggatgctggacttcttttcttttttttttcttttttttttttcaatttttcttttttgggatggagtctcactatgttgcccagactggtcttgaactcctgggctcaagtgatccttccatctcactttcctgagtagctgacattacgggtacactccatcaagcctggttcctaggatgctggacttctagcttagtgagaatgcagtatactttttgaaaacttcgtgcaggaatccctcaaatgctgtaactaggaatggcctcaagtgactaccatattaagttgctctac

SEQ ID NO: 466116 - DNA, 1412 bp, Homo sapiens
tcaaaagccctggagggtcggacatgagactggcatctgaagtggagatccagtctctcaagattctactgtttcccaagaggagaactcaaaagaggataaaatggtcactgtttgtcccaatactgagtcctgtggccgtaagacaaggaactgtggcagccaccagaagcaggaagaggcaaggaacagattatcccccagagcctctgaagggagcacagccctgccaacacctagatctcagacttctggcctccagaactgtgagagaacaaattcctattttgagtcaccaaggttatgggaatttgttacagctcccagaggaagatgaatcagctttagataaaataatagaaaggtgcctcagggatgatgatcatggcttgatggaagaatcccagcaatattgtggcagctcagaggaggatcacggtaatcagggaaattcaaaaggaagagtcgcacaaaacaaaactcttgggagtggcagtaggggtaagaaatttgacccagataaaagcccctttggacataatttcaaagaaacttcagacttaattaaacatctgagagtctacttgaggaagaaatctcggaggtataatgaaagcaagaaacccttcagttttcattcagaccttgttctgaaccgcaaggagaaaaccgccggagaaaagtcacggaaatctaatgatggtgggaaagtcctgagtcactcttcagctcttactgaacatcagaaacgtcagaagattcatttgggggataggtcccaaaaatgcagtaagtgtgggataatctttattagaagatcaactctttctaggagaaaaacccctatgtgtgagaaatgtcggaaagattcatgtcaagaagcagccttaaataaagatgagggaaatgagagtggagaaaaaactcataaatgtagtaagtgtggaaaagcctttggctatagcgcctcactcaccaaacatcggagaattcacactggagaaaaaccctatatgtgtaatgaatgtggaaaagcttttagtgatagttcatcgctcacaccacatcatagaactcatagtggagagaaacccttcaaatgtgatgactgtgggaaaggtttcaccctaagtgctcacctcattaaacatcagagaattcatactggagaaaaaccttataaatgtaaagactgtgggagaccctttagtgacagttcatctcttattcaacatcagcgaattcatactggagaaaaaccctatacatgtagcaattgtggaaaatccttcagtcatagctcatccctttccaaacatcagagaattcatactggagagaaaccctataaatgtggcgaatgtggaaaaggtttcaccctagggcctcacctcattaaacatcagagattc

SEQ ID NO: 466117 - DNA, 3363 bp, Homo sapiens
  misc_feature (2)..(2): n is a, c, g, or t
  misc_feature (4)..(5): n is a, c, g, or t
  misc_feature (7)..(7): n is a, c, g, or t
  misc_feature (9)..(9): n is a, c, g, or t
  misc_feature (13)..(13): n is a, c, g, or t
gntnntntncctntaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagttcctgtcccatctgcccagccaggtctcctcctgtgaggtagccctttctccctcagttaacacagagccagaagtgagctccagtcagcagcagcccccagtcgctccagccataaccactgaggccacagcacagtgcataccagaccaggatgaaagagcagctgagctcagcagggagcagaacgagaaaaccatccggagcacgcagaccgcgctccgcaatttccgtgagttcctcatctccaagtatccttctgaaacaagagagatttatgtcatcccttgcaaggagttggatgcctaccttgcctctttctttgttgatgccaggcagaaggatgggtccgaatacgaacccaacagcttggccaattaccagtgtgggctcgaaaggtacctgaaagaacacaggtatggctatagcatcaccagggataaggaattcaagcgttcccaagaggccctgaagcagaagcaaattgaactccgctgtaaaggaaaaggaaataagccacacaagtccatgaagctcacctttgctgacgagctcatcctgcggaaaaggggactgctaagccgatataaccccgagggtttgctcaacctagtctggctcaacaacacaaaagcttttgggcattgcacaggcttccatggatctaccttaaaatggggtgatatccggctccgggtaacagagacgggtctcgagtacttggagtggatgggtcaggacactggagacttgaatgccaaaaccaagagaggggggacagactcccgtgtgtatgccacccagcacgccccacagacctgccctgtccaggactataaggagtatgcccagcggcggcctcccgccatgcgctacgaggatgcccctttctacttatccatcaagccagtcgtgaacctggcggctctgcattggtacaactgccaggcccttggcaagaacaagctggccaagatggtgaagaccatgtgtgagaagggcaacatccctggcaggaaaaccaacttcagtgtgtatcagagctgcagcaccttgtctgaggcccagagcaaccagctcgtgctgatctgtaacaatctgagccagcaggctgcccagtcagtggccggccactccaacaatggcaatttcatcgtctccgcctcctatgactcttcctcagacaccgcttgaccaggtggcttgagcaagactccagtttggttactgtgtccggagaaactgtgattatacaccgcttctcgttccccttcctgtgccctcagtgttaattcactttataaaaatataaatatataatatatttttctttttacaaataagccaatggagataatttagtattactaacatagtatttataggcttaagacaaatgtacttgtgggcgatcaaatgtaattactgttacagactttacaaaaccatacgtggttctcaggcaacacaaagtagagagggaattctgttttttaaaaactgtcaaaaaggaaattgagagtcatcctagacttaacatgcttgcgtcctcaactcctgcttttcgttcccaccccaactccccttttttgtctccttaataaatggctttatttttttaatttttaaaattctatattaatcaagaggagacattaactttactgctgacgcaaaactgtattcagctagatccacaatatgaaaatgtataagctcaacatcaaattatttacatcttctcttttttaacttaattagagttttagctcctgtgcctcattttttacaatgtatgagaatctagatgtttagctaacatcttttctttttggggggaaagggtagaaggagggaataaaggtgccattctttttgggagatacatgattttaaaataatacccaaagtctaatattttggctaaaaagactgttacatagctcattttaactattgtgcttgaacctggaaagaatgtttctttttttgtccctaagaaatgggtataaatgaagtttgacaggaaatttaaagctaccaaagctttgaaaatgttgccaagcattagattgcctataaagaagagcctgttttaaaatcaataaagtgaaggcatttctgtaccatccactgtgttcatgtaggtgcacatatgcatcagagtgtacagatctgtcatcaatgactatcacctcttgagcactgacaatgtgccattgtactgagtgctttataagttgtttcacttaattctcacaatagtcccattagtaaagactgttcttattttaaggatg

SEQ ID NO: 466118 - DNA, 1112 bp, Homo sapiens
gaagagactgatcagtaaccagaagatgtgtgcaagtatggcctaggaccttcacaggaaatgaggccaagactgatggatttggaatcaatgtgggagaggtggaaaaggataatatggcatccacacgatgaagcattgcatcccaagtggctgaaacatcaagaaggttccagaaggcatctcaggcactatcaggatcaaccattacggtcatctccggttatcattccccagtctgatgatcagatattgaatggaataaaagctggcaacccccagccagcagctggcaacctgctggggtccccttccacgctgtggaagctttgtccttgcagtcttcacagtaaaccttgctaccactcactctttgggtctgtgccatctttaagagctgtaacactcactgcgaaggtccacagctttattcttgaagtcagcgagaccatgaacccaccggcaggaactgactctggacacaatggcggctcctgaccagaccctcagaacctgaggacgggtgatcatttctggtccagtgtcttgactggcaccaagtcaagcattgtcctccacgtcatcagctgcaggccagataatctaagatgatgccaaacagtcactgcagaagaatttgctgcacggagctgtctgggatgcctcagacctgccagcggtagagctgcctgccttgcttcctcttgcttactcacagctctaagtctgaacttggctgcagctgtcctgaacagcccaggaggagcctaggcaggaggaggcttctctcctatgcaatttggctgaattttagttactcaaaagagcaaaggaagcacttctgaatattcgtcaggaggagccaaccaccttagcttgctccctgatgggttttgttcagcccctgccttactgttgtcagcctggactgtcttctgggcttgggttcaccatgtgtctggaccacgggagtgtctctaggtgtctcccttcctgtgcatttctcctgggcatagacacccatcctgtggaacactgggaggagggtgcaagaccccactgcacccaggcttggttcctcttgggtgcagcagcctcatccccttgcaagc

SEQ ID NO: 466119 - DNA, 1593 bp, Homo sapiens
agtctagagcagtaggctctccaacttgcgactatgtcggaatccactgggtggcttgttgaagcacagactgctggttctgtttctgcgattaattatgtttatcgatttgcatatgttgaaccagccttgcatctccgggatgaagccaacttgatcatggtgcaggaaaaagtgaagctcacaaagttaaatgatgagtctaaagtggtacagcgtggaggtggccgatctagacttcaagccaggtctccaactccccttgtagttgtgaacgtctatgattcccccgctgtattcaaggctcctattcgaccagacatcgtgaactttgttcacaccaacttgcgcaaaaacaacagacagccctacgctgccagtgaattagcaggtcatcggaccagcactgagtcttggggtactggcagagctgtggctcgaattcccagagttcgaggtggtgggactcaccgctccggccagggtgcttttggaaacatgtgtcgtggaggccgaaggtttgcaccaaccaaaacctggcgccgttggcatcgtagagtgaacacaacccaaaaacggtatgccatctgttctgccctggctgcctcagccctaccagcactggtcatgtctaaaggtcatcgtattgaggaagttcctgaacttcctttggtagtcgaagataaagttgaaggctacaggaagaccaaggaagctgttttgctccttaagaaacttaaagccaggaacgatatcaaaaaggtctatgcctctcagcgaatgagagctggcaaaggcaaaatgagaaaccgtcgccgtatccagcgcaggggcccgtgcatcatctataatgaggataatggtatcaaggccttcagaaacatccctgcaattactctgcttaatgtaagcaagctgaccatttcgaagcttgctcctggtgggcacgtgggacgtttctgcatttggactggaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccaacgcaagaagatccatcgcagagtcctaaagaagaacccactgaaaaacttgagaatcatgttgaagctaaacccatatgcaaagaccatgcgccggaacaccattcttcgccaggccaggaatcacaagctccggatggataaggcagctgctgctgcagcggcactacaagccaaatcagatgagaaggcggcggttgcaggcaagaagcctgtggtaggtaagaaaggaaagaaggctgctgttggtgtgaagaagcagaagaagcctctggtgggaaaaaaggcagcagctaccaagaaatcagcccctgaaaagaagcctgcagaaaagaaacctactgtagaggaaaagaagcctgctgcattaactcttaaatttgattattccataaaggtcaaatcattgtggacagcttcttttgaataaagacctgattatacaggcagtgagaaacaaacaaa

SEQ ID NO: 466120 - DNA, 1164 bp, Homo sapiens
agtctagagcagtaggctctccaacttgcgactatgtcggaatccactgggtggcttgttgaagcacagactgctggttctgtttctgcgattaattatgtttatcgatttgcatatgttgaaccagccttgcatctccgggatgaagccaacttgatcatggtgcaggaaaaagtgaagctcacaaagttaaatgatgagtctaaagtggtacagcgtggaggtggccgatctagacttcaagccaggtctccaactccccttgtagttgtgaacgtctatgattcccccgctgtattcaaggctcctattcgaccagacatcgtgaactttgttcacaccaacttgcgcaaaaacaacagacagccctacgctgccagtgaattagcaggtcatcggaccagcactgagtcttggggtactggcagagctgtggctcgaattcccagagttcgaggtggtgggactcaccgctccggccagggtgcttttggaaacatgtgtcgtggaggccgaaggtttgcaccaaccaaaacctggcgccgttggcatcgtagagtgaacacaacccaaaaacggtatgccatctgttctgccctggctgcctcagccctaccagcactggtcatgtctaaaggtcatcgtattgaggaagttcctgaacttcctttggtagtcgaagataaagttgaaggctacaggaagaccaaggaagctgttttgctccttaagaaacttaaagccaggaacgatatcaaaaaggtctatgcctctcagcgaatgagagctggcaaaggcaaaatgagaaaccgtcgccgtatccagcgcaggggcccgtgcatcatctataatgaggataatggtatcaaggccttcagaaacatccctgcaattactctgcttaatgtaagcaagctgaccatttcgaagcttgctcctggtgggcacgtgggacgtttctgcatttggactggaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcgcctcccgatgtgccacacaatgcgccccccaa

SEQ ID NO: 466121 - DNA, 909 bp, Homo sapiens
cttgctctctcaccaaggctggagtgcaatgactgcgtacattgaacaaagcacctactatatgattctgtttatgagtccagaacaagcaaaacgaacagatggtgatggaggtcaaaacagtagtcagcaggacagtctctgctcaaatatcaccttaacagaggctccagcaccctatggcacatttcttataaaagccatagctagaaaagacgccgtcttgcctcaaattgttaacgttacttataagtgcaggaatgcaagagtctggaaatggaaagggcaagacaggagtctgagtggattagagcatctgagaagctctggaaaaaacctctcaggaaaacaacgacttcagcaggacccactagccaaggaaaggggataaaataaatagcaaagggaaggaaaaacacgcacctctgggatgctgcaggtcctgttgcagccgccgccatccctcgaagccaccgttgcttctgccagagctgctactagcgcgcttatcagctccgccaccgcccaagggggaaacttctgcagaaaccccaaccgagcttccgtctaacacaagctccaggccgggcgccgtggctcacgcctgtaatcccagcactttgggagtccgagacgggtggatcacgaagtcaggagttcaagaccagcctcgccaagatgctgaaaccccgtctacgaaaaatacaaaaattagccgggcgtgatggtgggcgcctgtaatcccagctactggggaggctgaggcaggagaatcgcttgaacctgggaggcagaggttgcagtgagccgagatcgcgccactgcaccacagcctgggcgacagagcaagactccttaataaataaataaataaataaaaaataaataaaataagctacttcgagctcc

SEQ ID NO: 466122 - DNA, 1536 bp, Homo sapiens
ccctgaatggcgctttgctgtgaatctccgcggggaggctcttccaaccaggggctgagcttctgcgctgtggagaagccagcctggagtctgcgggagcccagagaagaggggagtggaggttaattccaatatgaccgcatcgaggacgctttccgaaagggatagcaccccaaatctcactctatttgaagaaaatgtttggaagctctgtgaatacatcaaaaaccatgaccagtatcctttagaagaatgttatgctgtcttcatatctaatgagaggaagatgactgcccccttagtgtcccacagtttttgtggaattactgcccttcccagaatgttcacaaaccctgaacacagacgtctatccagtcctgttgttttgcatgaggttcaggagccttgtgggaaagaagccaaatggtctgtgttctcatttagggttcacacgtgtataggcttgtcccgtgggctagaggtcctcaaagatgtctttgctagaggagagaaaaacatgaacaggtccctgagagaaaatcaatacaaacatttttataattctaatttgggttaataaagattttaaaatatttcttggttaacttttgtaattatatacacaacaaatgtgtaaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttggtgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaatttgtttctatttcttaagtattttaaaacatagcaaagataattctgtgcaaaagaagtgtaaagtctgttctttcatatattactgtgaaaatttaaagtgctgttgacactggaatgtttttatatggtacatgtattttaggtacaacgactaaagtgcttcctgaaatgtcttctacagattttagaagtgttatgtctacattcctatgtagagtttgaaaaccatgctgaaattgcagtgttgaatgttatctcccatttgttgctcaaaagtgcagttaac

SEQ ID NO: 466123 - DNA, 1807 bp, Homo sapiens
  misc_feature (4)..(4): n is a, c, g, or t
  misc_feature (6)..(8): n is a, c, g, or t
  misc_feature (13)..(13): n is a, c, g, or t
  misc_feature (17)..(18): n is a, c, g, or t
  misc_feature (20)..(21): n is a, c, g, or t
accngnnncaggntggnntnnggtgtggcacaggacgggctccaggtgacgccggcccagagcaggctccaggtgtggcacaggacgggcaccaggtgatgcaggcccaggacgggctccaggtatggcacaggacgggctccaggtgacgctggcccaggatgggctccaggtgtggcacaggacgggctccaggtgacgccgccacaggacgggctccaggtgtggcacaggacgggctccaggtgtcgccggcacaggacgggctccaggtgtcgccggcacaggacgggctccaggtgtcgccggcacaggatgggctccaggtgtggcacaggacgggctccaggtgatgcaggcccaggacaggctccaggtgacgccagcccaggatgggctccaggtgtggcacaggacaggctccaagtgacgccggcccagagcaggctccaggtgtggcgcaggacgggcaccaggtgatgcaggcccaggacgggctccaggtgacgccagcccaggatgggctccaggtgtggcacaggacaggctccaagtgacgccggcccagagcaggctccaggtgtggcacaggacgggcaccaggtgatgcaggcccaggacgggctccaggtgacgccggcccaggatgggctccaggtgtggcacaagacaggctccaggtgtggcacaggacgggcaccaggtgtggcacaggacgggcaccaggtgtggcacaggacaggctccaggtgacaccggcccaggacgggctccaggtgacgccggcccaggacaggctccaggtgtggcacaggacgggcaccaggtgatgcaggcccaggacgggctccaggtgtggcacaggacgggctctaggtgatgcaggcccaggacgggctccaggtgtcgccggcccaggacgggcaccaggtgacgctggcccaggacgggctccaggtgacgcagacccaggacgagctccacgtgacgcaggcacaggactggcttcagctccacatagacgctctgtgtgatgagggcctaactgatgacctagagggggcagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcagcccagtgatgttctttcccttcttgacaaccgtggcagccattacgtggctattgtctttgaaagcaacagctcctaccttggacgggaggtgatcttagacctgatcccgtatgaaagcatcgtggtgacccgagcactggacggggacaaagcatttctggagaaacttggtgtttcttcagtcccttcgtgttacctgatctacccaaatggaactgcagaaccttggcaagccctttgcctctgcgtggggtgcccgtgtgcccctcatgaggataagcccttcgcccctgcgtggggtgcctgtgtgcccctcatgaggataagccctttgcccctgcgtggggtgcccgtgtgcccctcatgaggataagcccttcgcccctgcgtggagtgcctgtgtgcccctcatgaggataagccctttgcctctgtgtggagtgcctgtgtgcccctcatgaggataagccctttgcctctgc

SEQ ID NO: 466124 - DNA, 2246 bp, Homo sapiens
  misc_feature (4)..(4): n is a, c, g, or t
  misc_feature (6)..(8): n is a, c, g, or t
  misc_feature (13)..(13): n is a, c, g, or t
  misc_feature (17)..(18): n is a, c, g, or t
  misc_feature (20)..(21): n is a, c, g, or t
accngnnncaggntggnntnnggtgtggcacaggacgggctccaggtgacgccggcccagagcaggctccaggtgtggcacaggacgggcaccaggtgatgcaggcccaggacgggctccaggtatggcacaggacgggctccaggtgacgctggcccaggatgggctccaggtgtggcacaggacgggctccaggtgacgccgccacaggacgggctccaggtgtggcacaggacgggctccaggtgtcgccggcacaggacgggctccaggtgtcgccggcacaggacgggctccaggtgtcgccggcacaggatgggctccaggtgtggcacaggacgggctccaggtgatgcaggcccaggacaggctccaggtgacgccagcccaggatgggctccaggtgtggcacaggacaggctccaagtgacgccggcccagagcaggctccaggtgtggcgcaggacgggcaccaggtgatgcaggcccaggacgggctccaggtgacgccagcccaggatgggctccaggtgtggcacaggacaggctccaagtgacgccggcccagagcaggctccaggtgtggcacaggacgggcaccaggtgatgcaggcccaggacgggctccaggtgacgccggcccaggatgggctccaggtgtggcacaagacaggctccaggtgtggcacaggacgggcaccaggtgtggcacaggacgggcaccaggtgtggcacaggacaggctccaggtgacaccggcccaggacgggctccaggtgacgccggcccaggacaggctccaggtgtggcacaggacgggcaccaggtgatgcaggcccaggacgggctccaggtgtggcacaggacgggctctaggtgatgcaggcccaggacgggctccaggtgtcgccggcccaggacgggcaccaggtgacgctggcccaggacgggctccaggtgacgcagacccaggacgagctccacgtgacgcaggcacaggactggcttcagctccacatagacgctctgtgtgatgagggcctaactgatgacctagagggggcagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcacgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggactttgtgactgtcttggccaagctgttccctggacggccgccagtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggccatctgagtgaggatccccggtttccaaagcttcagtggcccactccggacctctgcccagcctgccatgaggaaattaagggcctggccagctgggatgaaggccacgtgctcacattcttgaagcagcactatggccgcgacaacctcttagacacgtattccgcagaccaaggggattccagtgaaggagg

SEQ ID NO: 466125 - DNA, 2480 bp, Homo sapiens
  misc_feature (4)..(4): n is a, c, g, or t
  misc_feature (6)..(8): n is a, c, g, or t
  misc_feature (13)..(13): n is a, c, g, or t
  misc_feature (17)..(18): n is a, c, g, or t
  misc_feature (20)..(21): n is a, c, g, or t
accngnnncaggntggnntnnggtgtggcacaggacgggctccaggtgacgccggcccagagcaggctccaggtgtggcacaggacgggcaccaggtgatgcaggcccaggacgggctccaggtatggcacaggacgggctccaggtgacgctggcccaggatgggctccaggtgtggcacaggacgggctccaggtgacgccgccacaggacgggctccaggtgtggcacaggacgggctccaggtgtcgccggcacaggacgggctccaggtgtcgccggcacaggacgggctccaggtgtcgccggcacaggatgggctccaggtgtggcacaggacgggctccaggtgatgcaggcccaggacaggctccaggtgacgccagcccaggatgggctccaggtgtggcacaggacaggctccaagtgacgccggcccagagcaggctccaggtgtggcgcaggacgggcaccaggtgatgcaggcccaggacgggctccaggtgacgccagcccaggatgggctccaggtgtggcacaggacaggctccaagtgacgccggcccagagcaggctccaggtgtggcacaggacgggcaccaggtgatgcaggcccaggacgggctccaggtgacgccggcccaggatgggctccaggtgtggcacaagacaggctccaggtgtggcacaggacgggcaccaggtgtggcacaggacgggcaccaggtgtggcacaggacaggctccaggtgacaccggcccaggacgggctccaggtgacgccggcccaggacaggctccaggtgtggcacaggacgggcaccaggtgatgcaggcccaggacgggctccaggtgtggcacaggacgggctctaggtgatgcaggcccaggacgggctccaggtgtcgccggcccaggacgggcaccaggtgacgctggcccaggacgggctccaggtgacgcagacccaggacgagctccacgtgacgcaggcacaggactggcttcagctccacatagacgctctgtgtgatgagggcctaactgatgacctagagggggcagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcacgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggactttgtgactgtcttggccaagctgttccctggacggccgccagtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggtgagaagcccctgggcatggggggctcagcacgggcggagggaggccctggtcctgggacagcaaggacggcacggctgccgtggggcttgtccctgagctttgcggcctcgtgccacccactgtgctgacgggatcaggacttgggtggctgagagctgccagagctgcagcctttcccaggctgcttctgtccccggctttctagatgcttctctcactccgggggctcttcgaccccgtggaaatgggtgtggctctttcttcccccatcggtacccactggtagcccgttagactctgaagatgtttttgactctggaaagcttggaacgtaattaatttttgatgaggaattttagtagtatggaaatctgttgtccaaacgtaaaccaaacctctcaaagtgctttgttttgttaaaaaaaaa

SEQ ID NO: 466126 - DNA, 1498 bp, Homo sapiens
tccggttcagcgcctctgcgcaggcgcagtggttcccgcaggcttgcgcgcgcactcgctgcgggacaagcttctggaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaaggtgagatttatagatggagggaggaagcgggagacattgcctcaaagtccgaaagtaaattcctcaaaagaaggcaatttactgctaaagaggagtctgaggttagaagttgggactgggtttgaatcagccctgccatttactgtgtgattttgggcaagctgtgtaaactctcagaatgtaaatatttttatctgttaaaaagggattttatctttcttgtagttttcttgtaaaggtgagacaagataggatataatatatggtggatgctcaagaaatagtaatttctttcccatccccttcaagaacacaagttatctgtgaaagtgtttggagtcacaggcaaatcaaccagctcaggccctaatgcctagttccattgtgtggactagcacgttgctagagggtggctgtgagtgtctttgctgatggaaatgtttctgcactgttttgcaattcaagtacatgaaaagcagctagtgcaaataaggaactgaattttttaaatcaaatttaaagtttaaatagccacatgcgactagtaactattttatagtgcagttccacagccttagggcaggaaaacctggatatatgtatgtaattacatattataaatacaaatgtataaactataaactgaattacggtgatatcattataaaatattgatgtaaagtcttctagggtgagtagtcctttcagggaatgtggctcgccttttttctcaaatttgtagctatttatgttctcaaatatgatacaaatatttgtattttgcagtgtaatatgctacaaatatttggaatatttgtagtatattatttaccat

SEQ ID NO: 466127 - DNA, 2006 bp, Homo sapiens
cccggggcccaggcacccacccaactgagctgcggcagagggcagcgggctctctgcaaactgtaacaagttggctctgtggccctgtctgtcagaggaggaggctgttcccaggagacgtgggctccacgggagacgcgccggctgcgctcagcggggagaggttgtcgctccagtccctagtggagcattcccagctgccagcacagagaggctgggctcaagtcttctccaaggccagtgccaccctccaccaggtcccactgagcctcatggggctggtggagccacctgcccacctcagcactgcatctccagccagggctgagtggcagtgtgggcaccgcggcccgggacgacagcctgggctcagagtcaggcttgtggcttcgcctctcagcttgcgtctcctcccctgtgggatgggggattccgtggcacccccatgatgaacaggatgccatgggcctcagcccagggcagacctcagtgtccttcctgtggccgctgctggaggtgcgtgaccacaacacagggaggggactcgtccccgccactgtgctgacgcctgggtctccagagaccctcctggaactccgccaggccttcctgggttccagacaggcccgccacgggcatgacgcagcgccatctagcggacagcagggctgcagcgtggacagaacggccggacgcccagtcctgggctggcggctgaggaacagcctcacagggcaagagggcaggcaacacctgcatctttccggcataagaacctcaagaaaagcaaaggaatataagcctgtgttctttggagccaccgaaatctctgttctcatggcagtcgctgaaagtttaagggagccgccaccgccccaatggggttggtttctttcttccctgtttttaaagatcttttaaaatgtctagagagaccctgggatccagtgctggacggatgatgcagggccacacagagaggctattgtgtgtcacttgctgggttaggaacagacggatcagggcttctatgctgcgtctgcctggtcctgggagagagaaactcacacaaccatctgcctggaagacctgggcttctcaggctagagggtctgcacatgtaggccaacctgtcacacccggcttcagctcccacctgcccgaggagaatgctctcaggccgccctgcaggctctgggccggggctctgcctcctcctcccaaagacccagcgagtccagacttcaccctcctccagctgccatccagccccccggcacccctaggcccagctgccccctcccatcccacctgctccaatgcaccctccacacagagagaatgtgtcaccatacatgcttcatggtgccactgtcctgctggaagtcgtcggaggctggcactcttctcaggatgtgctgtcctctgccaaccccaccggtcttgcccccaggtcctggcctcagccccttgggtcctttattccatgtttactgtacccactcccacagtcagacacggcttccgtgttccctgtgcccagaactcctcccccagggggtcagcccatccccaagatctcagccacagtcacttcccccgggtggggctcctgaccctggaatcagtcagatgctccgggactcgcagtttggggagtagggtggtaatgcccgtctcctggtgggctgcccgtgtcaacccaaacgtcaccccttgacaaagacacctgagcccctgcacttggaagtagcagcccccagccagcagacgggactcgtacacatcaccgtgtcttacactcttgcctgtcaccgcgtccccttatcttcccctttagtgtatttacttcccgccacccttccctccgcactagaatgtctgctccatgtaggcaagtagtttgggtcctgcaccagatagacacgcaatacatgtttgttgaatgactaaaggaaagacaatggtctttggagatcctcctttcatggaggccctgggcttgg

SEQ ID NO: 466128 - DNA, 1723 bp, Homo sapiens
ggctggtacaggtccggagatttaaggatctccagccagggctgagtggcagtgtgggcaccgcggcccgggacgacagcctgggctcagagtcaggcttgtggcttcgcctctcagcttgcgtctcctcccctgtgggatgggggattccgtggcacccccatgatgaacaggatgccatgggcctcagcccagggcagacctcagtgtccttcctgtggccgctgctggaggtgcgtgaccacaacacagggaggggactcgtccccgccactgtgctgacgcctgggtctccagagaccctcctggaactccgccaggccttcctgggttccagacaggcccgccacgggcatgacgcagcgccatctagcggacagcagggctgcagcgtggacagaacggccggacgcccagtcctgggctggcggctgaggaacagcctcacagggcaagagggcaggcaacacctgcatctttccggcataagaacctcaagaaaagcaaaggaatataagcctgtgttctttggagccaccgaaatctctgttctcatggcagtcgctgaaagtttaagggagccgccaccgccccaatggggttggtttctttcttccctgtttttaaagatcttttaaaatgtctagagagaccctgggatccagtgctggacggatgatgcagggccacacagagaggctattgtgtgtcacttgctgggttaggaacagacggatcagggcttctatgctgcgtctgcctggtcctgggagagagaaactcacacaaccatctgcctggaagacctgggcttctcaggctagagggtctgcacatgtaggccaacctgtcacacccggcttcagctcccacctgcccgaggagaatgctctcaggccgccctgcaggctctgggccggggctctgcctcctcctcccaaagacccagcgagtccagacttcaccctcctccagctgccatccagccccccggcacccctaggcccagctgccccctcccatcccacctgctccaatgcaccctccacacagagagaatgtgtcaccatacatgcttcatggtgccactgtcctgctggaagtcgtcggaggctggcactcttctcaggatgtgctgtcctctgccaaccccaccggtcttgcccccaggtcctggcctcagccccttgggtcctttattccatgtttactgtacccactcccacagtcagacacggcttccgtgttccctgtgcccagaactcctcccccagggggtcagcccatccccaagatctcagccacagtcacttcccccgggtggggctcctgaccctggaatcagtcagatgctccgggactcgcagtttggggagtagggtggtaatgcccgtctcctggtgggctgcccgtgtcaacccaaacgtcaccccttgacaaagacacctgagcccctgcacttggaagtagcagcccccagccagcagacgggactcgtacacatcaccgtgtcttacactcttgcctgtcaccgcgtccccttatcttcccctttagtgtatttacttcccgccacccttccctccgcactagaatgtctgctccatgtaggcaagtagtttgggtcctgcaccagatagacacgcaatacatgtttgttgaatgactaaaggaaagacaatggtctttggagatcctcctttcatggaggccctgggcttgg

SEQ ID NO: 466129 - DNA, 1464 bp, Homo sapiens
gccgctgctctagggaggacaggcccagcggagcagctgatggactaaaaactggccatctttgatcagagggatcgtggatttttgcaactttcctggccagacttcgtcaaggccctgccggcctgctggacactgattgatcaaagattgatcaaacagctcctcccctcactgagggcagatgcttgcttcaaggatcaaacagcccggctctgccaggcaccgcccagcagcagaaggttgtgcttcaagtctgcacagccctccaactttggatgtttcttagaccaccggggatgcaagtcttctagtcctttctattcagaccagcactgacggtgaaggagctgaggccagggttggccatgtggaggcgtagggagatggaacatcggggacgcactgcttctctcctgctcacgtagaacttgaggacagaggctctgtctggcatctgaagacccagcaaagcccagctctgccagcagcttgccaggacctgagaaagcccctctctccccgggcctcagtttccccagatgtacgtggagggattggcctaaatgagctcagcggatctcatggccccgatcctggcaggttggtgactggctgccctgtccccagccctgtgggggttcaaggtgtgagccttgtggtgggggtacacagggtcccccaaattcatgtatatccagagcctcagaatgagaccttatttggaaacagagtatttgcggatacaattaggtaaggacctctagctagaagcatcctggatttcgggtgggccccaaatccaatgactgctggagaggacgccagagccacagggagaagcggccacgtggagacggaggcagaggctggagtgaagtggccaaaagccagggcgcgcctgggccaccagaagccggacgagtacaggaagcagccacggaacatggatctgagccccgagagattcctggatgtgggagacccaccctctgtccttggtggttgctgctgccaagcttcggaaacgatcctggaattcagctccgtcagggctttgcctggatgggccatggtctactctggctgtcacctggacacggcgctgtcacctggacatgacgctgtcccgaaggcgcagaggcgacagcgcccgcaccccacgctcgagcttcagagacgctttgctcacttcacactgccagaggcgcaagagcccggggcgaagacccgctgagctgtaagagaataaatttgttctttttaaagccattcagtttgtggagatttgttacagtggcaatgggagacgaatgcactcatctttgtgcacctggccggctgctgctatagactagagtcctagacatgaatttgccccactgaagggtgtgctcactgtccatttctattgacaccgtgaagttgtccaataaatacgctttgcacgttgacacttccatc

SEQ ID NO: 466130 - DNA, 758 bp, Homo sapiens
gtgaattgtctgtgtgtgtcccttggccgtttctgaatcatttattatgtttaaaccagatcacatcttgggagaggcctcctggctgagggccagatgctggttacttggacacagtggatataatggcttgggtccccagatctccctgcagagttcacccatcccctcttcagctggccttggagggatgatcctctcctagcagcactgtgctcaccatgttttttccaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacag

SEQ ID NO: 466131 - DNA, 355 bp, Homo sapiens
ctaattagcgtgacctgaatcagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtaggagccgccctctgtcccgcttttctccatcccccttcccttgctttcttccaaacttccctccctcccagggcttccctactggaaattgaataaaacaagggcttt

SEQ ID NO: 466132 - DNA, 9905 bp, Homo sapiens
  misc_feature (84)..(84): n is a, c, g, or t
  misc_feature (216)..(218): n is a, c, g, or t
  misc_feature (220)..(220): n is a, c, g, or t
  misc_feature (226)..(229): n is a, c, g, or t
  misc_feature (239)..(239): n is a, c, g, or t
  misc_feature (243)..(243): n is a, c, g, or t
cagctctggcagaagcaacggtggcttcgagggatggcggcggctgcaacaggacctgcagcatcccagaggaactgactaagnctttggaacagaaaccagatgatgcacaatattatcgtcaaagagcttattgtcacattcttcttgggaattactgtggtgcagatgctaatttcagtgactggattaaaaggtgtcgaagctcagaatggnnngnaatctnnnntgtttgtggngaantatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgtaagtgctgggcgggtatcctgtcattgacatgttctgagagctggggtccccccaactgctatgtggacccatggtcttggccctgacccagagatgggccatgatagtaactcatggtggggggaaacagcgttcacaaaaggctgcctctcacaccattccacaatgccctcacaaccatgtatggggtgggggatacatatgtccattttccagctgggaaaattgaggtttaggaaagtaaaatgagaggcaagacagtatgatggaaggaagcagggaatcctggcaaagcttttggatctgctgtgtgacctgggcctcagttttctcctctgcacaatgggcgtgggaatgccttgtaagtgtaaagcatggaactcacattaccattgtcctgccgggtggtcaacctgtctcccctctctcactgggcatcagagaaggatctggcagaagggaaaaggctgcctcaggatggccccaccctgtgtttcagccttacaatatccatcgttgtgggtctcatgatcctgcagatgtgtatcgctgccagcttcttcctacagccaaagctgggcacggctgacaagcagaagcccctggctctcaacaacaggaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgagtcgacgttccccagccgcctaccccccagcagagagtccttccccggggagtcctgccctggggtgccgcctcgaggccagacgtcgtcccgcctggacctgaacctgagtttgggacgggcgatttcccaacctcaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaaagagtcaccagcccccaccccaacccacccccggttaacccacgtggcatccggctttccacctggataaaggggacagcagagcatatggcaggagcacagacctggaagcaagtggcccagatccctgctcagctgctggccaacttggttctacaaccccccatgactgagtttcctcacatgcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacgaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctgaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaaacttcgagctggcttcttcgagcaccttgagaagtggtttgaccagtgttccctcaacacccgggtcaccgtggccaccaaaatcaatgagctggattcagaactggagctgcatctgcacctgcaccagccaagagcccagcagattgaaaaagacatccacaacgtcagggcagccgagcttttgcttcatcaagagcagttggacagccactgtgctggggtgaccgagacgctgaagaagaagcggctgatgttctgccagttccaagaagagcaaaacgtgaggagcaaaaacttccgccttaagatctatgacatggagcacatcttcttgaatgccaccaggagccaaaagctggtcactctcagcaacacactgcaccaggagttgcttagctatgttgatgtcacccaggtgtccctgcgcagcttccggcagtacttggaggagagtctgggcaaactccgctactcaaatattgagttcatcaaacactgcagattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggcccttctctctggcctgcagaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaaggtagaggcgcatgggcctgtgggtctcggggcagcagtgaggcaggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcagaaacccaggcagggatcctgcaggctcagacctgccttgcgtctgtccacagcctccagaccacccacccacctttgtcccacagcttcacaccgcaccccaagcccaacaaaatggagagaaagtaccgggtgcttggggacaagcctccccctgctgccgaacagcggccccctctcatcagccctctcaccctggagacctcgtctctgggggtcatgaacttggcagagaaggatggctgtgacatcaggcaacccaggtgtggcctccagctggcagctaatcgaggcactgcccggtacaggcactgccatggggctggggattccatggtgaacaagtacagacaggtccatgtcctggattttaaggggatcatcttgaccctcctctgggagagcagtgagaacctgctgacagtcgcagaggcacccaggcccagtggaaagctgacagacctggcgggggcacagaaagaggtggggcagtgggaccaggcaccagacaagctgcccagtgccctgttcccacatgccctgcaccgtagaaataacgagggctggccatggctccactcactccaggtgggcccagggaggcgacacgggcagacagggaaggaggagtgtctgctcgtgtcacttccacaggggatgccacgagcaaaggctagggagtgtggaggtgagggcaggctggtggatcccaggagcaagggccagagtcccatggagtcctcacccgcacatggtcaccctctctggcaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggaatgtaccagaaggaatggccaggttttcataaccaacttggccaccttcaccgagaagttcctactgcagttggatgaggtggtcaccattgacgatgtccaggttgcaagtaagaggcaccaccagccttgtgtcatggccctggggggctggtgaaccttggctgggctggccagtcaacactcctcctcttcagcattttcagttgctgcacaccataatgtaataagcattgtaacttactaattagtccctttgctattgaactttggaccatttccaatttcccactcctgtaattgtgctgaagagaatctctgcatccatgcatctctagagcaacagactcctagaagtgcgatgtctggatcaaagtgtgtacagatttttgaagtgttggtcacttttctctatcagaggtctctgtcaaaggtgagccttgtttgggaaatcagcgccttgcagagatgctggggtcgagaccccagggagaacaggcaggtgagctggtagtggagcagatcacagtgccttgcaaggaacccctgagccaggaagactccctgcaccaggccctaggaggcctctgcctactctgcaactcggcttctgagccaggccaccgggccctgccattcatggcagaggagtgtacatgttacctgctggctctctgcacacagagccccccaccccctcgcccctgatctagaaagaacatcagagcatcaaagattggattattgagctagatagtcaagggacaaccttgaacgtgtttgttccaggggaggttcttagttcggaacccatatgagctagcctaagccaaagaagtctctatgaaccatatccggggactcatggaaactgcagcaacgtcagagcatcaggcttgggtttggagctgggaacagcacccacaccaccgcttagattcctccatccatgaccccctgcccctgtcaccaccccgagctgtgtggctggtgcattcagcttctccatggagagggctcagcctgccataactccaagtgggaggaggggtgccagtcctcccttttctaagtgtaatgccaggggaaatccctcgatctcaggctgtcggtgaggctgcagtcactagcctgtcttttgcctctagggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttataattgcaactctgcactggttcctagacccaacaaataactaatccaatgttgattggtatttgtgccacaatttgtctgagcaaattgcaatattttggaaaaaaaaaaatcttccaggctcctttagtcctgtgttgcccagatcattctcttggagtcctccagcctgccagtctcttgttcgtcaactctcttcttcaattacatggcgtgagcgtacagccttcatttgtcggtagctgtgtgtgtcatctggacaggtttcctcagccatagacctaggaggccccagctcccaaatttccagcccctgaaagctgtgtgaccctccaagtgcagttccctcacctggggacactcactctgctctcctggtttgctccacccagtgaggccctgcttggttagcttggttagcttggtggcctttgtgcactgaagccaggagagtgaggagtccccttccatcaaggcaaaagcaatctcctgttcttttctgtgctccccccacccccaccccaatagagttgtttaacactctattgtaaaaaggcaacagtcccaagggtctctgtctgcacctcttttagtctaggtttgaataaagagcagagagtctggttaatgtataacatctcaatgcaaaggtcagaaagtaaaggtcatgcaccaaagaagaaaaacagtcatattatgtgagtcagcttccaggacttttccctttggcataataaatttggaagatcctgaaacttaattttctttttataagaggctcctagaaactggactaagacttcaagaagttatgcagaacacaccagaaaatcgcaccaagaatcaggaagatctcaacttggatgagaacagacaatcagtatgtgtgaataccaagatgccagatgttggaattatctgacagtggtttgaaatagccataataataatgttttaataagcaattataaacacacttgaaacaaatgaaaaattagaaaatcgtaacaaaaaaatagaagaaagaaatccaagtggaagcttcaactgaaaaatataataaccaaaatttaaaaactcaatgtgt

SEQ ID NO: 466133 - DNA, 2821 bp, Homo sapiens
cttgatgatcctgctaaattctgaacttcccaacacaaaatggccaacccaccattgtgacaaagatccgtcccagacaggtagaggcgcatgggcctgtgggtctcggggcagcagtgaggcaggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttataattgcaactctgcactggttcctagacccaacaaataactaatccaatgttgattggtatttgtgccacaatttgtctgagcaaattgcaatattttggaaaaaaaaaaatcttccaggctcctttagtcctgtgttgcccagatcattctcttggagtcctccagcctgccagtctcttgttcgtcaactctcttcttcaattacatggcgtgagcgtacagccttcatttgtcggtagctgtgtgtgtcatctggacaggtttcctcagccatagacctaggaggccccagctcccaaatttccagcccctgaaagctgtgtgaccctccaagtgcagttccctcacctggggacactcactctgctctcctggtttgctccacccagtgaggccctgcttggttagcttggttagcttggtggcctttgtgcactgaagccaggagagtgaggagtccccttccatcaaggcaaaagcaatctcctgttcttttctgtgctccccccacccccaccccaatagagttgtttaacactctattgtaaaaaggcaacagtcccaagggtctctgtctgcacctcttttagtctaggtttgaataaagagcagagagtctggttaatgtataacatctcaatgcaaaggtcagaaagtaaaggtcatgcaccaaagaagaaaaacagtcatattatgtgagtcagcttccaggacttttccctttggcataataaatttggaagatcctgaaacttaattttctttttataagaggctcctagaaactggactaagacttcaagaagttatgcagaacacaccagaaaatcgcaccaagaatcaggaagatctcaacttggatgagaacagacaatcagtatgtgtgaataccaagatgccagatgttggaattatctgacagtggtttgaaatagccataataataatgttttaataagcaattataaacacacttgaaacaaatgaaaaattagaaaatcgtaacaaaaaaatagaagaaagaaatccaagtggaagcttcaactgaaaaatataataaccaaaatttaaaaactcaatgtgt

SEQ ID NO: 466134 - DNA, 1956 bp, Homo sapiens
gcggccgctccaacatcagaatggtaacgcctggtgagagagcaagaccgtgactcaaaaataacgaaaattggatgcataaatgagggtgccagatgtgcagggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttataattgcaactctgcactggttcctagacccaacaaataactaatccaatgttgattggtatttgtgccacaatttgtctgagcaaattgcaatattttggaaaaaaaaaaatcttccaggctcctttagtcctgtgttgcccagatcattctcttggagtcctccagcctgccagtctcttgttcgtcaactctcttcttcaattacatggcgtgagcgtacagccttcatttgtcggtagctgtgtgtgtcatctggacaggtttcctcagccatagacctaggaggccccagctcccaaatttccagcccctgaaagctgtgtgaccctccaagtgcagttccctcacctggggacactcactctgctctcctggtttgctccacccagtgaggccctgcttggttagcttggttagcttggtggcctttgtgcactgaagccaggagagtgaggagtccccttccatcaaggcaaaagcaatctcctgttcttttctgtgctccccccacccccaccccaatagagttgtttaacactctattgtaaaaaggcaacagtcccaagggtctctgtctgcacctcttttagtctaggtttgaataaagagcagagagtctggttaatgtataacatctcaatgcaaaggtcagaaagtaaaggtcatgcaccaaagaagaaaaacagtcatattatgtgagtcagcttccaggacttttccctttggcataataaatttggaagatcctgaaacttaattttctttttataagaggctcctagaaactggactaagacttcaagaagttatgcagaacacaccagaaaatcgcaccaagaatcaggaagatctcaacttggatgagaacagacaatcagtatgtgtgaataccaagatgccagatgttggaattatctgacagtggtttgaaatagccataataataatgttttaataagcaattataaacacacttgaaacaaatgaaaaattagaaaatcgtaacaaaaaaatagaagaaagaaatccaagtggaagcttcaactgaaaaatataataaccaaaatttaaaaactcaatgtgt

SEQ ID NO: 466135 - DNA, 4358 bp, Homo sapiens
  misc_feature (84)..(84): n is a, c, g, or t
  misc_feature (216)..(218): n is a, c, g, or t
  misc_feature (220)..(220): n is a, c, g, or t
  misc_feature (226)..(229): n is a, c, g, or t
  misc_feature (239)..(239): n is a, c, g, or t
  misc_feature (243)..(243): n is a, c, g, or t
cagctctggcagaagcaacggtggcttcgagggatggcggcggctgcaacaggacctgcagcatcccagaggaactgactaagnctttggaacagaaaccagatgatgcacaatattatcgtcaaagagcttattgtcacattcttcttgggaattactgtggtgcagatgctaatttcagtgactggattaaaaggtgtcgaagctcagaatggnnngnaatctnnnntgtttgtggngaantatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgtaagtgctgggcgggtatcctgtcattgacatgttctgagagctggggtccccccaactgctatgtggacccatggtcttggccctgacccagagatgggccatgatagtaactcatggtggggggaaacagcgttcacaaaaggctgcctctcacaccattccacaatgccctcacaaccatgtatggggtgggggatacatatgtccattttccagctgggaaaattgaggtttaggaaagtaaaatgagaggcaagacagtatgatggaaggaagcagggaatcctggcaaagcttttggatctgctgtgtgacctgggcctcagttttctcctctgcacaatgggcgtgggaatgccttgtaagtgtaaagcatggaactcacattaccattgtcctgccgggtggtcaacctgtctcccctctctcactgggcatcagagaaggatctggcagaagggaaaaggctgcctcaggatggccccaccctgtgtttcagccttacaatatccatcgttgtgggtctcatgatcctgcagatgtgtatcgctgccagcttcttcctacagccaaagctgggcacggctgacaagcagaagcccctggctctcaacaacaggaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgagtcgacgttccccagccgcctaccccccagcagagagtccttccccggggagtcctgccctggggtgccgcctcgaggccagacgtcgtcccgcctggacctgaacctgagtttgggacgggcgatttcccaacctcaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacgaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacagtgagtaaaaaactattttattctcaac

SEQ ID NO: 466136 - DNA, 5267 bp, Homo sapiens
  misc_feature (84)..(84): n is a, c, g, or t
  misc_feature (216)..(218): n is a, c, g, or t
  misc_feature (220)..(220): n is a, c, g, or t
  misc_feature (226)..(229): n is a, c, g, or t
  misc_feature (239)..(239): n is a, c, g, or t
  misc_feature (243)..(243): n is a, c, g, or t
cagctctggcagaagcaacggtggcttcgagggatggcggcggctgcaacaggacctgcagcatcccagaggaactgactaagnctttggaacagaaaccagatgatgcacaatattatcgtcaaagagcttattgtcacattcttcttgggaattactgtggtgcagatgctaatttcagtgactggattaaaaggtgtcgaagctcagaatggnnngnaatctnnnntgtttgtggngaantatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgtaagtgctgggcgggtatcctgtcattgacatgttctgagagctggggtccccccaactgctatgtggacccatggtcttggccctgacccagagatgggccatgatagtaactcatggtggggggaaacagcgttcacaaaaggctgcctctcacaccattccacaatgccctcacaaccatgtatggggtgggggatacatatgtccattttccagctgggaaaattgaggtttaggaaagtaaaatgagaggcaagacagtatgatggaaggaagcagggaatcctggcaaagcttttggatctgctgtgtgacctgggcctcagttttctcctctgcacaatgggcgtgggaatgccttgtaagtgtaaagcatggaactcacattaccattgtcctgccgggtggtcaacctgtctcccctctctcactgggcatcagagaaggatctggcagaagggaaaaggctgcctcaggatggccccaccctgtgtttcagccttacaatatccatcgttgtgggtctcatgatcctgcagatgtgtatcgctgccagcttcttcctacagccaaagctgggcacggctgacaagcagaagcccctggctctcaacaacaggaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgagtcgacgttccccagccgcctaccccccagcagagagtccttccccggggagtcctgccctggggtgccgcctcgaggccagacgtcgtcccgcctggacctgaacctgagtttgggacgggcgatttcccaacctcaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacgaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctgaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccgtaagtgttcaatagattctgcatgtgaataataaagatatatcatgctaaagtcataaatgtgaaataaatttacctgtgtgtataggatttctccagcacaaggttggcggggtggggggacatctctgagccttcctacttaacccctgtttcatggaatgaagaaaggaacaaaagagaaagcagccactgttcacctccaacccctcccaggcaagcatggagcagcgtctagtgttgggggaggcctgagtctggcttcctctgacctcactcccttgggatgtcaccaggtgtc

SEQ ID NO: 466137 - DNA, 458 bp, Homo sapiens
caagcagaacacaagaggaagagctacgagagcgctctggccagctttcaggaggagattgcgcaggtgggaaaggtgagaatcctccctctcccttctcttcccttcctgtgccattccaaaggtgggtgtgtcatggctcccagccttcctccccctctccagcagagaggtcctcaggggctcacagagccttagacgacatggaaccctctctgagtgcctgagtggcttgttatgagtgtttgtgggcacaggtccccatagttcttggaaaagccctacaggtcatgtgctgttgttaccccttttgcagtgaggcccagagagtctcacctgacttggtgcataagggcccaagtcagaacttccctccaggtctgacaccaaagcctagccttcggcctccctgctcagtccttctgatgaagggcagaatggcacaccccttgctgata

SEQ ID NO: 466138 - DNA, 526 bp, Homo sapiens
tttcctttggaagactttggaacagctgcagctaggaataggtccctcgtgcaacagacagtggggaagccccaccctctgccataatcactgacccagctgcagccctgtgaaattccttatcatgcaggaagcctcaaactccaaggatcgcatgaaacaatgactgtccccactgacatacattcttcactgtgctcagtggcccccacactgtacctgagccattcctcacaccagtgctgtgaggtgagggcaatcagctcccctttatggcacgaggtcacaaagctttgagcctggacctgtaggatttgaccctgggtctgggggactccagagcctacctgcctagcaaccttgctctactgaaaggttgaaaggtggtgccttgggctggcttctgtttgcaggaaagcgttccacaacttcaactactttctgttcttctacaacgtgctgctgggcctgggtgcctgcctttccaggctgctcatcagttgcctcctcggcatgtggctgattg

SEQ ID NO: 466139 - DNA, 758 bp, Homo sapiens
agaccatgggcgtccagctgcagttgtcgctggaccggccctggctgcctcgagagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctccgtgttcatattttcggctggaatcggcgatgtactagaggaagttattcgtcaagcatggtgtttatcatcccaaatgtcaaaggtgtgtccaagtttatggatttcgatgaaactggggtggctcaaaggattcacaggagaactaattcatgtatttaacagacctgatggtgccttgaggaatacagaata

SEQ ID NO: 466140 - DNA, 2280 bp, Homo sapiens
cttgatgatcctgctaaattctgaacttcccaacacaaaatggccaacccaccattgtgacaaagatccgtcccagacaggtagaggcgcatgggcctgtgggtctcggggcagcagtgaggcaggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggaatgtaccagaaggaatggccaggttttcataaccaacttggccaccttcaccgagaagttcctactgcagttggatgaggtggtcaccattgacgatgtccaggttgcaagtaagaggcaccaccagccttgtgtcatggccctggggggctggtgaaccttggctgggctggccagtcaacactcctcctcttcagcattttcagttgctgcacaccataatgtaataagcattgtaacttactaattagtccctttgctattgaactttggaccatttccaatttcccactcctgtaattgtgctgaagagaatctctgcatccatgcatctctagagcaacagactcctagaagtgcgatgtctggatcaaagtgtgtacagatttttgaagtgttggtcacttttctctatcagaggtctctgtcaaaggtgagccttgtttgggaaatcagcgccttgcagagatgctggggtcgagaccccagggagaacaggcaggtgagctggtagtggagcagatcacagtgccttgcaaggaacccctgagccaggaagactccctgcaccaggccctaggaggcctctgcctactctgcaactcggcttctgagccaggccaccgggccctgccattcatggcagaggagtgtacatgttacctgctggctctctgcacacagagccccccaccccctcgcccctgatctagaaagaacatcagagcatcaaagattggattattgagctagatagtcaagggacaaccttgaacgtgtttgttccaggggaggttcttagttcggaacccatatgagctagcctaagccaaagaagtctctatgaaccatatccggggactcatggaaactgcagcaacgtcagagcatcaggcttgggtttggagctgggaacagcacccacaccaccgcttagattcctccatccatgaccccctgcccctgtcaccaccccgagctgtgtggctggtgcattcagcttctccatggagagggctcagcctgccataactccaagtgggaggaggggtgccagtcctcccttttctaagtgtaatgccaggggaaatccctcgatctcaggctgtcggtgaggctgcagtcactagcctgtcttttgcctctagggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacag

SEQ ID NO: 466141 - DNA, 1380 bp, Homo sapiens
cttgatgatcctgctaaattctgaacttcccaacacaaaatggccaacccaccattgtgacaaagatccgtcccagacaggtagaggcgcatgggcctgtgggtctcggggcagcagtgaggcaggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacag

SEQ ID NO: 466142 - DNA, 1457 bp, Homo sapiens
  misc_feature (84)..(84): n is a, c, g, or t
  misc_feature (216)..(218): n is a, c, g, or t
  misc_feature (220)..(220): n is a, c, g, or t
  misc_feature (226)..(229): n is a, c, g, or t
  misc_feature (239)..(239): n is a, c, g, or t
  misc_feature (243)..(243): n is a, c, g, or t
cagctctggcagaagcaacggtggcttcgagggatggcggcggctgcaacaggacctgcagcatcccagaggaactgactaagnctttggaacagaaaccagatgatgcacaatattatcgtcaaagagcttattgtcacattcttcttgggaattactgtggtgcagatgctaatttcagtgactggattaaaaggtgtcgaagctcagaatggnnngnaatctnnnntgtttgtggngaantatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgtaagtgctgggcgggtatcctgtcattgacatgttctgagagctggggtccccccaactgctatgtggacccatggtcttggccctgacccagagatgggccatgatagtaactcatggtggggggaaacagcgttcacaaaaggctgcctctcacaccattccacaatgccctcacaaccatgtatggggtgggggatacatatgtccattttccagctgggaaaattgaggtttaggaaagtaaaatgagaggcaagacagtatgatggaaggaagcagggaatcctggcaaagcttttggatctgctgtgtgacctggggtaagttattccacttctctgcacctcagtttacatatctggaagacaaagtaatgttggcttcattgagcatttagtatgcatcttttctcataatagcctatgaacttgga

SEQ ID NO: 466143 - DNA, 4180 bp, Homo sapiens
  misc_feature (84)..(84): n is a, c, g, or t
  misc_feature (216)..(218): n is a, c, g, or t
  misc_feature (220)..(220): n is a, c, g, or t
  misc_feature (226)..(229): n is a, c, g, or t
  misc_feature (239)..(239): n is a, c, g, or t
  misc_feature (243)..(243): n is a, c, g, or t
cagctctggcagaagcaacggtggcttcgagggatggcggcggctgcaacaggacctgcagcatcccagaggaactgactaagnctttggaacagaaaccagatgatgcacaatattatcgtcaaagagcttattgtcacattcttcttgggaattactgtggtgcagatgctaatttcagtgactggattaaaaggtgtcgaagctcagaatggnnngnaatctnnnntgtttgtggngaantatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgtaagtgctgggcgggtatcctgtcattgacatgttctgagagctggggtccccccaactgctatgtggacccatggtcttggccctgacccagagatgggccatgatagtaactcatggtggggggaaacagcgttcacaaaaggctgcctctcacaccattccacaatgccctcacaaccatgtatggggtgggggatacatatgtccattttccagctgggaaaattgaggtttaggaaagtaaaatgagaggcaagacagtatgatggaaggaagcagggaatcctggcaaagcttttggatctgctgtgtgacctgggcctcagttttctcctctgcacaatgggcgtgggaatgccttgtaagtgtaaagcatggaactcacattaccattgtcctgccgggtggtcaacctgtctcccctctctcactgggcatcagagaaggatctggcagaagggaaaaggctgcctcaggatggccccaccctgtgtttcagccttacaatatccatcgttgtgggtctcatgatcctgcagatgtgtatcgctgccagcttcttcctacagccaaagctgggcacggctgacaagcagaagcccctggctctcaacaacaggaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgagtcgacgttccccagccgcctaccccccagcagagagtccttccccggggagtcctgccctggggtgccgcctcgaggccagacgtcgtcccgcctggacctgaacctgagtttgggacgggcgatttcccaacctcaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacgaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaatgaaaaaactgaggaagaagcaagggtctaaagaggaggttgcccagaagaaaaagatatcccagaagaaactgaagaaacaaaaacttatggcccgggagtaaattcagcattaaaataaatgtaattaaaagga

SEQ ID NO: 466144 - DNA, 1793 bp, Homo sapiens
gggtccctgaaaatattgtcaagcttgttttgtttttgttttgttttgttttgtttttgaacagctagccaagattctaaagaaacccagacaaggcagggtggagaccgagaggagaaatttattccagaaattaactgttagcagtagtgtttcttaatacataagctatatcatactcctcaagtagattctttgcttaaaactttcactgtaaataattttatagcaaccatgtgaataacttaagaataatagaatcagtctcatttgtaggcactgtagaccatctccattccctacatgtcagagactctgggggatgaattggagatattaagaggtaaaatgatgcagagaagaccaaggtcagcagaagtcaaatacttctatttctttaaaattttgcttaggctacgcctggctattttgaagtatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgaggttattgtgtaatttctgttgctctgtcttcaatttcactgactcttatgtcacctctaattttctgttaagctcattcagtgaattttttacttcagatattgttttaaaatttccatttgttcttttttatagtttctctttcactgctgagaatttctatttgctcattcattacaaccatatttttctttacatcttttagcatagtgattactatgttatgttattactgctttgaaatctttggatactaatttcaaaatctgagtcatctcatggattctattaatatctctgaaatgtagatgaatattccttccccttctcctcactttatgtattttatagatggctactgtcattctataggatttagaggggagaactaatatatgtgtttcctgctttcttaaaacaaaagccagataattttgaaagaaatcaattataacctcatttgaaacataggctaatctaattaaagctaagatcttagcgatctctaagatcctcaagatctcagctttaattagattaatctgtttgaaagggagaaagttttggtgaaaaaatatgctaaattccttattttataaataggagaactgagacgtagccttttttaattgatagaaaaaatattgaaatacatgtattataaaattaatgataatgcattgatttacaataagatgttctcagcccaaaagcttcttaagctgataagcaacttcagcaaagtctcaggatacaaaatcaatgtgcaaaaattgctagcattcctatacaccaacaacaggcaagcagtttgtatggaaccaaaaaacagcccaaatagccaagataatcctaagcaaaaagaacaaagctggaggcatcatgctacccaacttcaaactatgctacaaggctccagtaaccaaaacagcatgttactggtacaagaacagacacatagaccaatggaacagaatagagaactcaaataagaccacacacctacaaccatctgatcttcaacaaaactgacaaaaacaagcaatggggtaaggactccttatttaataaatggtgctgggggagctggc

SEQ ID NO: 466145 - DNA, 865 bp, Homo sapiens
ggcgttccggcatcgtcgcctggtgtgatttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccaggcaggcggatcacaaggtcaggagttcgagactagtctggccaacatagtgaaaccccatctctactaaaaatacaaaaaaaactagccgagtgtggtggtgcgcacctgtaatcacagctactcgggaggctgaggcaggaggatcgcgtgaactcgggaggcggaggttgcagtgagccgagatcacactattgcactccagcccaggcaacagtgcgagactccatctcaaaataaataattaattaaaaatctccataagagaaaacaaaaaaaaaaaacaaaactgtgcgggcgccagcgccgaaaaggttttagaccactcgttggcggaccagaggtagggacagggcccacgggccagaaccggccgagacgggcggttcccccaaaaagcccgggacggggcgaacccagcgttcgcgctctgttcacggcagggctacccgccgcgccgggaccgcagcccccacccacggacagacgcacgcaggcaccacaggaacaacacgcaccgacgcgcgc

SEQ ID NO: 466146 - DNA, 4612 bp, Homo sapiens
agcggtctggcatcgtcgcctggtgcgtgatttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccaggtgagtgggaagccctgggcaagcgagggtgcagggcagtgaggagctcagcaggtaaggaaggaggggctatctttgaggtgctaggaggaagttcttcttcaggcctcctaggccactggtaaaggctgcatggcactgcctgccttccacactgtgtgcctccccccaggacagggcacccctggcattccatctccttcctccatcagggagcctcactcctcacttggcttcctttctcgagcacattcaggatttctccattcttgggctcatgtggttggcatgatcttcaaaacagtacctgtcctttgagactaagtccctgcccctggttttttatttttatttttattttttttgagacagagtctcgttctgtcacccaggctggagtgcaatggcatgatctcggctcactgcaacctctgcctcctgtgttcaagtgatttctcctgcctcaccctcctgagtagctgggactacaggtgcccgccatcatgcccagctaaatttttttgtatttttagtagagatggggtttcaccttattggtcaggctggtcttgaattcctgagctcaggcaatccatctgcctttgcttcccaaagtgttgggattacaggcgtgagccaccacgcccagccagtttctattcttaacctggtagcttttttgtgcatcatttctatcctgtaaattctcataactttgtttcttttatcatagattatttaagattacagcaaggtgtgaaaaactgtacaatgagtagggttggggcagccctgtaccctaagagatagcatgttataaaaccaggtaatagccccatacttttcctgattgtgtcccgttcctccgcctctgttttctgagttagcattccatgactgtctttatccttttattccatctgatgggttcttcactcatatagggtgttgttttgcatgtctgtaaacttctctgcacataatgttattaagttgtttccaactttttggctatgaaataatcttgctctgtattcttgtatgcctccttgggaacatgtccaagagtttctcttaaaatatataccggccaggtgcagtggctcacacctgtaatcccagcactctgggaggccgaggcaggtggatcacgaggtcaggaattcgagaccattctggccaacatggtgaaaccccgtctctactaaaaatagaaaaattagctgggtgtggtggcgcatgcctataatcttagctacttgggaggctgaggcaggagaattgcttgaatccgggaggcggacgttgcagtgaactgagattgcgccactgcactccagcctaggtgacagagcgagtctccatctcacaaagaaaaaaaaaaagatatatacttaggtgtgtagtagctggttcacaggcatgcatagcctcaacttatataagttatgccaacttgtgttctgaagtgggcatggcagcttatgctcccagcaggagtctatgagaattcttgttgtacatcctcaccaacatttgggattgtgagacctcatgttttatccatctattcagctggaagtgaaatctcagaggggtttttaagttgcttactagtgagcatgagcatcttttcatatgttgcttggcccttcctgtttccccatctgtgatttgaccattcaaggtgtttgcctacttttcaatgggtctattctttttgttattgatttgtagaaatcccatataaattatggaaacatttaggtctttaactggaattaattttatatgaatgctgggagatagaaataaatttttgcctgctttatcttcttacttgtttattttcatggtttcctggcattttatttttgttttattttttgcttttaaatgtaactatatagctggtattacactatgtagcaactgagtgcttttgtctttttaaaagcatttcgttatataaaaatggggtgggcacagtggctcacgcctgtaatcccagactttgagaggctgaggtgggtggatcacttgaggccaggagtttgagaccagcctggccaacatggcaaaatcccgtctctactaaaaatacacaaattagccgagcctggtggtgcatgcctgaaataccagctactcggatggctgaggagtgagaatcgcttgaacctgggaggcgaaggttgcaatgaactgagatcacaccactgtactccagcctgggctacagagtgagactctgtctcaaaaaaaaataaagtaaaataatgataaaaatgttattaagatacagcaattaaggtatattataagatatgttttttaaggtataataaactacacttatataggtgtgaaatttggttagttttggcatatgtatacatgcatgaaagcactgccacagctaaagtaacaagcatgtctgtcatccttgaaaattttctttcgccttactgtaatcctacctcccactccttcctgtcctcccctgtacctgggcaaccactgatcagctttctataattatagatttgtctgcattttctagaatttgtataactggattatacaggatacaactggattcttcactcagcataagtattttgaattttatctataatgtgtgtatcaatagtttattaatttttattgctgagtattcctttatatgtctaggtcacattttaatactgacctattaaaaggtatttgggttttcatttttgacaaatataaataaagctgttttaagcatgcaagtttttgtgtgaatataatgctttcatttctgttgaataaatacctgggactggaatggctgggttgtatgatgatggatacaatatatattcaacttttgaagaaactcacaaactgctttccaaagtggccgcaccatttcacattcccacagcagtgtatgagagctccaggtgttccatatttgtcaaaacttggcttggttattaatttcagacattcttatagctgtgtagtgagtggcatcttaccgtggttttaacattttcttaatgactgatgatgttgagtatcttcatgtgcttatttgctatcttatatcttctttagtgaagtacgttttcacatcttttgcccatttaaaaatgtggtttcttatttttgtattattgagtttgagagttcttcacatattctatgtagaagtccattatcagatatatgatttacaaacattttttctgtggtttactttctataatcttaatagtgcctttcaaagagaaattttaatttggatgaagtccagttttcaatcttttctcttatgaattgcagttttggtagtgtatttaagaaattttagtctaaagtaaggtcaaaaagattctcatttttttcttttagtaattttacaatttttaattacatttaggtctataagcctattttgagtaaatatacttgataaaagatctgaatttatgtacttttttaggggaggaagggcatacaaatatccaatttttccagcaccatttattgaaaacactacccttttttaactgaatttcctatgtatctttgtggaagatcagttgaccatatgtgataggtctatacctggactctatgttttttctactcctctgttagtgtctctatgccaataccacagttttgattactgtagctttattaggtcttgaactcactgtaaatcctccatcttctttgggaagcttaggcaggcggatcacaaggtcaggagttcgagactagtctggccaacatagtgaaaccccatctctactaaaaatacaaaaaaaactagccgagtgtggtggtgcgcacctgtaatcacagctactcgggaggctgaggcaggaggatcgcgtgaactcgggaggcggaggttgcagtgagccgagatcacactattgcactccagcccaggcaacagtgcgagactccatctcaaaataaataattaattaaaaatctccataagagaaaacaaaaaaaaaaaacaaaactgtgcgggcgccagcgccgaaaaggttttagaccactcgttggcggaccagaggtagggacagggcccacgggccagaaccggccgagacgggcggttcccccaaaaagcccgggacggggcgaacccagcgttcgcgctctgttcacggcagggctacccgccgcgccgggaccgcagcccccacccacggacagacgcacgcaggcaccacaggaacaacacgcaccgacgcgcgc

SEQ ID NO: 466147 - DNA, 4630 bp, Homo sapiens
ctcctcctctaaggttatcctccttcaaaaggaggaatatttttattgactcaagcacagggtagaatcaacatactgcctttaggtctaggatcccctccctgtatgcatcctttcttagcattcagacatagtttactccacccctgcacctccctaccaccttctgggtttattgcattcctgggttggctctgagttctgagatagcctcttaagccactaactcaagatcaccttggtttttttttcctgtgagtaggaattgcattttccaaaccaaaactcatcgaacagctggagcaaggcgacgaaccttggagagaggagaacgaacatcttctggacctttgtccaggtgagtgggaagccctgggcaagcgagggtgcagggcagtgaggagctcagcaggtaaggaaggaggggctatctttgaggtgctaggaggaagttcttcttcaggcctcctaggccactggtaaaggctgcatggcactgcctgccttccacactgtgtgcctccccccaggacagggcacccctggcattccatctccttcctccatcagggagcctcactcctcacttggcttcctttctcgagcacattcaggatttctccattcttgggctcatgtggttggcatgatcttcaaaacagtacctgtcctttgagactaagtccctgcccctggttttttatttttatttttattttttttgagacagagtctcgttctgtcacccaggctggagtgcaatggcatgatctcggctcactgcaacctctgcctcctgtgttcaagtgatttctcctgcctcaccctcctgagtagctgggactacaggtgcccgccatcatgcccagctaaatttttttgtatttttagtagagatggggtttcaccttattggtcaggctggtcttgaattcctgagctcaggcaatccatctgcctttgcttcccaaagtgttgggattacaggcgtgagccaccacgcccagccagtttctattcttaacctggtagcttttttgtgcatcatttctatcctgtaaattctcataactttgtttcttttatcatagattatttaagattacagcaaggtgtgaaaaactgtacaatgagtagggttggggcagccctgtaccctaagagatagcatgttataaaaccaggtaatagccccatacttttcctgattgtgtcccgttcctccgcctctgttttctgagttagcattccatgactgtctttatccttttattccatctgatgggttcttcactcatatagggtgttgttttgcatgtctgtaaacttctctgcacataatgttattaagttgtttccaactttttggctatgaaataatcttgctctgtattcttgtatgcctccttgggaacatgtccaagagtttctcttaaaatatataccggccaggtgcagtggctcacacctgtaatcccagcactctgggaggccgaggcaggtggatcacgaggtcaggaattcgagaccattctggccaacatggtgaaaccccgtctctactaaaaatagaaaaattagctgggtgtggtggcgcatgcctataatcttagctacttgggaggctgaggcaggagaattgcttgaatccgggaggcggacgttgcagtgaactgagattgcgccactgcactccagcctaggtgacagagcgagtctccatctcacaaagaaaaaaaaaaagatatatacttaggtgtgtagtagctggttcacaggcatgcatagcctcaacttatataagttatgccaacttgtgttctgaagtgggcatggcagcttatgctcccagcaggagtctatgagaattcttgttgtacatcctcaccaacatttgggattgtgagacctcatgttttatccatctattcagctggaagtgaaatctcagaggggtttttaagttgcttactagtgagcatgagcatcttttcatatgttgcttggcccttcctgtttccccatctgtgatttgaccattcaaggtgtttgcctacttttcaatgggtctattctttttgttattgatttgtagaaatcccatataaattatggaaacatttaggtctttaactggaattaattttatatgaatgctgggagatagaaataaatttttgcctgctttatcttcttacttgtttattttcatggtttcctggcattttatttttgttttattttttgcttttaaatgtaactatatagctggtattacactatgtagcaactgagtgcttttgtctttttaaaagcatttcgttatataaaaatggggtgggcacagtggctcacgcctgtaatcccagactttgagaggctgaggtgggtggatcacttgaggccaggagtttgagaccagcctggccaacatggcaaaatcccgtctctactaaaaatacacaaattagccgagcctggtggtgcatgcctgaaataccagctactcggatggctgaggagtgagaatcgcttgaacctgggaggcgaaggttgcaatgaactgagatcacaccactgtactccagcctgggctacagagtgagactctgtctcaaaaaaaaataaagtaaaataatgataaaaatgttattaagatacagcaattaaggtatattataagatatgttttttaaggtataataaactacacttatataggtgtgaaatttggttagttttggcatatgtatacatgcatgaaagcactgccacagctaaagtaacaagcatgtctgtcatccttgaaaattttctttcgccttactgtaatcctacctcccactccttcctgtcctcccctgtacctgggcaaccactgatcagctttctataattatagatttgtctgcattttctagaatttgtataactggattatacaggatacaactggattcttcactcagcataagtattttgaattttatctataatgtgtgtatcaatagtttattaatttttattgctgagtattcctttatatgtctaggtcacattttaatactgacctattaaaaggtatttgggttttcatttttgacaaatataaataaagctgttttaagcatgcaagtttttgtgtgaatataatgctttcatttctgttgaataaatacctgggactggaatggctgggttgtatgatgatggatacaatatatattcaacttttgaagaaactcacaaactgctttccaaagtggccgcaccatttcacattcccacagcagtgtatgagagctccaggtgttccatatttgtcaaaacttggcttggttattaatttcagacattcttatagctgtgtagtgagtggcatcttaccgtggttttaacattttcttaatgactgatgatgttgagtatcttcatgtgcttatttgctatcttatatcttctttagtgaagtacgttttcacatcttttgcccatttaaaaatgtggtttcttatttttgtattattgagtttgagagttcttcacatattctatgtagaagtccattatcagatatatgatttacaaacattttttctgtggtttactttctataatcttaatagtgcctttcaaagagaaattttaatttggatgaagtccagttttcaatcttttctcttatgaattgcagttttggtagtgtatttaagaaattttagtctaaagtaaggtcaaaaagattctcatttttttcttttagtaattttacaatttttaattacatttaggtctataagcctattttgagtaaatatacttgataaaagatctgaatttatgtacttttttaggggaggaagggcatacaaatatccaatttttccagcaccatttattgaaaacactacccttttttaactgaatttcctatgtatctttgtggaagatcagttgaccatatgtgataggtctatacctggactctatgttttttctactcctctgttagtgtctctatgccaataccacagttttgattactgtagctttattaggtcttgaactcactgtaaatcctccatcttctttgggaagcttaggcaggcggatcacaaggtcaggagttcgagactagtctggccaacatagtgaaaccccatctctactaaaaatacaaaaaaaactagccgagtgtggtggtgcgcacctgtaatcacagctactcgggaggctgaggcaggaggatcgcgtgaactcgggaggcggaggttgcagtgagccgagatcacactattgcactccagcccaggcaacagtgcgagactccatctcaaaataaataattaattaaaaatctccataagagaaaacaaaaaaaaaaaacaaaactgtgcgggcgccagcgccgaaaaggttttagaccactcgttggcggaccagaggtagggacagggcccacgggccagaaccggccgagacgggcggttcccccaaaaagcccgggacggggcgaacccagcgttcgcgctctgttcacggcagggctacccgccgcgccgggaccgcagcccccacccacggacagacgcacgcaggcaccacaggaacaacacgcaccgacgcgcgc

SEQ ID NO: 466148 - DNA, 4240 bp, Homo sapiens
agcggtctggcatcgtcgcctggtgcgtgatttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccagagtctcgttctgtcacccaggctggagtgcaatggcatgatctcggctcactgcaacctctgcctcctgtgttcaagtgatttctcctgcctcaccctcctgagtagctgggactacaggtgcccgccatcatgcccagctaaatttttttgtatttttagtagagatggggtttcaccttattggtcaggctggtcttgaattcctgagctcaggcaatccatctgcctttgcttcccaaagtgttgggattacaggcgtgagccaccacgcccagccagtttctattcttaacctggtagcttttttgtgcatcatttctatcctgtaaattctcataactttgtttcttttatcatagattatttaagattacagcaaggtgtgaaaaactgtacaatgagtagggttggggcagccctgtaccctaagagatagcatgttataaaaccaggtaatagccccatacttttcctgattgtgtcccgttcctccgcctctgttttctgagttagcattccatgactgtctttatccttttattccatctgatgggttcttcactcatatagggtgttgttttgcatgtctgtaaacttctctgcacataatgttattaagttgtttccaactttttggctatgaaataatcttgctctgtattcttgtatgcctccttgggaacatgtccaagagtttctcttaaaatatataccggccaggtgcagtggctcacacctgtaatcccagcactctgggaggccgaggcaggtggatcacgaggtcaggaattcgagaccattctggccaacatggtgaaaccccgtctctactaaaaatagaaaaattagctgggtgtggtggcgcatgcctataatcttagctacttgggaggctgaggcaggagaattgcttgaatccgggaggcggacgttgcagtgaactgagattgcgccactgcactccagcctaggtgacagagcgagtctccatctcacaaagaaaaaaaaaaagatatatacttaggtgtgtagtagctggttcacaggcatgcatagcctcaacttatataagttatgccaacttgtgttctgaagtgggcatggcagcttatgctcccagcaggagtctatgagaattcttgttgtacatcctcaccaacatttgggattgtgagacctcatgttttatccatctattcagctggaagtgaaatctcagaggggtttttaagttgcttactagtgagcatgagcatcttttcatatgttgcttggcccttcctgtttccccatctgtgatttgaccattcaaggtgtttgcctacttttcaatgggtctattctttttgttattgatttgtagaaatcccatataaattatggaaacatttaggtctttaactggaattaattttatatgaatgctgggagatagaaataaatttttgcctgctttatcttcttacttgtttattttcatggtttcctggcattttatttttgttttattttttgcttttaaatgtaactatatagctggtattacactatgtagcaactgagtgcttttgtctttttaaaagcatttcgttatataaaaatggggtgggcacagtggctcacgcctgtaatcccagactttgagaggctgaggtgggtggatcacttgaggccaggagtttgagaccagcctggccaacatggcaaaatcccgtctctactaaaaatacacaaattagccgagcctggtggtgcatgcctgaaataccagctactcggatggctgaggagtgagaatcgcttgaacctgggaggcgaaggttgcaatgaactgagatcacaccactgtactccagcctgggctacagagtgagactctgtctcaaaaaaaaataaagtaaaataatgataaaaatgttattaagatacagcaattaaggtatattataagatatgttttttaaggtataataaactacacttatataggtgtgaaatttggttagttttggcatatgtatacatgcatgaaagcactgccacagctaaagtaacaagcatgtctgtcatccttgaaaattttctttcgccttactgtaatcctacctcccactccttcctgtcctcccctgtacctgggcaaccactgatcagctttctataattatagatttgtctgcattttctagaatttgtataactggattatacaggatacaactggattcttcactcagcataagtattttgaattttatctataatgtgtgtatcaatagtttattaatttttattgctgagtattcctttatatgtctaggtcacattttaatactgacctattaaaaggtatttgggttttcatttttgacaaatataaataaagctgttttaagcatgcaagtttttgtgtgaatataatgctttcatttctgttgaataaatacctgggactggaatggctgggttgtatgatgatggatacaatatatattcaacttttgaagaaactcacaaactgctttccaaagtggccgcaccatttcacattcccacagcagtgtatgagagctccaggtgttccatatttgtcaaaacttggcttggttattaatttcagacattcttatagctgtgtagtgagtggcatcttaccgtggttttaacattttcttaatgactgatgatgttgagtatcttcatgtgcttatttgctatcttatatcttctttagtgaagtacgttttcacatcttttgcccatttaaaaatgtggtttcttatttttgtattattgagtttgagagttcttcacatattctatgtagaagtccattatcagatatatgatttacaaacattttttctgtggtttactttctataatcttaatagtgcctttcaaagagaaattttaatttggatgaagtccagttttcaatcttttctcttatgaattgcagttttggtagtgtatttaagaaattttagtctaaagtaaggtcaaaaagattctcatttttttcttttagtaattttacaatttttaattacatttaggtctataagcctattttgagtaaatatacttgataaaagatctgaatttatgtacttttttaggggaggaagggcatacaaatatccaatttttccagcaccatttattgaaaacactacccttttttaactgaatttcctatgtatctttgtggaagatcagttgaccatatgtgataggtctatacctggactctatgttttttctactcctctgttagtgtctctatgccaataccacagttttgattactgtagctttattaggtcttgaactcactgtaaatcctccatcttctttgggaagcttaggcaggcggatcacaaggtcaggagttcgagactagtctggccaacatagtgaaaccccatctctactaaaaatacaaaaaaaactagccgagtgtggtggtgcgcacctgtaatcacagctactcgggaggctgaggcaggaggatcgcgtgaactcgggaggcggaggttgcagtgagccgagatcacactattgcactccagcccaggcaacagtgcgagactccatctcaaaataaataattaattaaaaatctccataagagaaaacaaaaaaaaaaaacaaaactgtgcgggcgccagcgccgaaaaggttttagaccactcgttggcggaccagaggtagggacagggcccacgggccagaaccggccgagacgggcggttcccccaaaaagcccgggacggggcgaacccagcgttcgcgctctgttcacggcagggctacccgccgcgccgggaccgcagcccccacccacggacagacgcacgcaggcaccacaggaacaacacgcaccgacgcgcgc

SEQ ID NO: 466149 - DNA, 1594 bp, Homo sapiens
ctcctcctctaaggttatcctccttcaaaaggaggaatatttttattgactcaagcacagggtagaatcaacatactgcctttaggtctaggatcccctccctgtatgcatcctttcttagcattcagacatagtttactccacccctgcacctccctaccaccttctgggtttattgcattcctgggttggctctgagttctgagatagcctcttaagccactaactcaagatcaccttggtttttttttcctgtgagtaggaattgcattttccaaaccaaaactcatcgaacagctggagcaaggcgacgaaccttggagagaggagaacgaacatcttctggacctttgtccaggtgagtgggaagccctgggcaagcgagggtgcagggcagtgaggagctcagcaggtaaggaaggaggggctatctttgaggtgctaggaggaagttcttcttcaggcctcctaggccactggtaaaggctgcatggcactgcctgccttccacactgtgtgcctccccccaggacagggcacccctggcattccatctccttcctccatcagggagcctcactcctcacttggcttcctttctcgagcacattcaggatttctccattcttgggctcatgtggttggcatgatcttcaaaacagtacctgtcctttgagactaagtccctgcccctggttttttatttttatttttattttttttgagacagagtctcgttctgtcacccaggctggagtgcaatggcatgatctcggctcactgcaacctctgcctcctgtgttcaagtgatttctcctgcctcaccctcctgagtagctgggactacaggtgcccgccatcatgcccagctaaatttttttgtatttttagtagagatggggtttcaccttattggtcaggctggtcttgaattcctgagctcaggcaatccatctgcctttgcttcccaaagtgttgggattacaggcgtgagccaccacgcccagccagtttctattcttaacctggtagcttttttgtgcatcatttctatcctgtaaattctcataactttgtttcttttatcatagattatttaagattacagcaaggtgtgaaaaactgtacaatgagtagggttggggcagccctgtaccctaagagatagcatgttataaaaccaggtaatagccccatacttttcctgattgtgtcccgttcctccgcctctgttttctgagttagcattccatgactgtctttatccttttattccatctgatgggttcttcactcatatagggtgttgttttgcatgtctgtaaacttctctgcacataatgttattaagttgtttccaactttttggctatgaaataatcttgctctgtattcttgtatgcctccttgggaacatgtccaagagtttctcttaaaatatataccggccaggtgcagtggctcacacctgtaatcccagcactctgggaggccgaggcaggtggattggctgggcccagggaggtgcaggctgctgtgagctgagattgcaccattgcatagcagtctgggtaacagagtgagaccttgtctc

SEQ ID NO: 466150 - DNA, 1768 bp, Homo sapiens
gggaagcatctggactctgcatgtaagattttgtgattgtcctttctcccttgctttcctcgtctggctcctggctgccccttgggccggcgcctctcgctcgctctattccttctccccgcggctgcctcgtgccggccgcaccttctcgccgcggaccggagccggggcaggagccggggcaggaacccgggcagaagccggggcaggaaccaggacaggaagcggggcaggaaccaggacaggaagcagggcaggagccccgcaggagccaggtgtctgagccccgccccgccgcgggggagaggcctccgggagccggggccgcccagagccgcagccgccgcgcaggcagggccgggccgggccgggtgcgcgggcacaaaggggccgctgcacatggcaggcaggcgagcagatgccagcagacagctttttgttttgtggaaggtagtacttgcaagggatgaaactggatattttactgaggagatttctaagcaaaatgtcgaagaagtgacttggttcctcccagttgattgtagtaaaatgcaagaagagagaaatgaattgaaaaaggaattgttgagcaaaaatgaaccagagtttaaagatttggaaaattctctgtctgttcatatgacgaaaaatgagaaagtgtgtactgaagagaacactaagggtgtggtggaccaaccatttcataaagagattagtgtggctgtgtaccatgaacttaatcagccatttcaacagaggccgggaatacagatgggattacacctgcagagacactgctggctgggactaaaaaaaacagaacatggaatggaatgaaggaaggccgtgactttgtgctatcatctagtaaaagggatgaagggccccgaggcaatttggaggtcctctgcctccaatttgaaggactattgccctggtttcaatagtccagacagcttccaaccaaagatgtggaggcacaatctttgcctggtagagaagctaggggtgcaacatctggccaggaatgctgctggggtgggacctttaccctagtggctccagaaggcagggcatcaaaccaaggattactcccaagccttaagatttcatggagtttgctttgtagtttggacttgcttgggactgggtcaccccttccttctgtgtttcttgcttttggaatgggaatgcctatcctatgcctgtcccaccaatgtattttggaagtatacaacttgtttggtttcacagattcgcagctggagaggaattttgccccaggatgaatcataactcaagtctcactgtacctaatttagaagatatttagaaaagactttggactttagacattagcgttgttgctggaatgagttaagactttggaggatggaatgaatgtacagatgctccttgacttagaatggggttatgtcccaataaacccattgtaagtaaaaaaatatataagtaaaaatgcattcagtaccctgataaacccatggtaaagtcaaaaaatcagaagatgcttttcaacttacaatggggttatttatttcctgatagacccatcgcaaaatttaaaaattgtaagttgaaccatcatatgttgaggacaatgtgtatttggcacatgagaaggacatgaattttggggggccaggggtagaatgctatggactgaacttatgtgtctccctaaaattcgtacgttatgaccctagttcctaatgtgatgaggaaataaatgttcattgtttaggcc

SEQ ID NO: 466151 - DNA, 875 bp, Homo sapiens
ttttttttttttttttttttttttttttttttttttgatgtatctgtcccttgccatgggctccacagagtgtgtgctcctggccgtgatggcatatgaccgttatgtggccatttgtaacccgctgagatactccatcatcatgaacaggtgcgtctgtgcacggatggctacggtctcctgggtgacgggttgcctgaccgctctgctggaaaccagttttgccctgcagatacccctctgtgggaatctcatcgatcacttcacgtgtgaaattctggcggtgctaaagttagcttgcacaagttcactgctcatgaacaccatcatgctggtggtcagcattctcctcttgccaattccaatgctcttagtttgcatctcttacatcttcatcctttccactattctgagaatcacctcagcagagggaagaaacaaggctttttctacctgtggtgcccatttgactgtggtgattttgtattatggggctgccctctctatgtacctaaagccttcttcatcaaatgcacaaaaaatagacaaaatcatctctctgccagctttgacacaaggaactgagcagattggcatggaaccaagtgttttagaatgggatatagaccagaatgggacaacaaaatggatgagaaataacccagatgtcagaagaggactcagaacagaacctggcaattatcataatttgtaattcaataataatttgtgggtttccttgtttgatggctatgtccctcactggtctgtaggttcactgaggcaatgaccatatcaatttcatttactactgtatacccaggacctagcacaagtctggcatagagaagacagacattcactgcatacttttt

SEQ ID NO: 466152 - DNA, 1660 bp, Homo sapiens
atgcaggccgatcgcctcagaagccgcctagaccatcacagatgttgagcttcagctacacctcattgccgcccttttccctagttcaaagcctcctttgcatcctcctctcatatccccccaccttaacccacaagtatgagcctctctttgctttcacttgggctggccctgacacccatcagcctcagcaacttacctgggctgtactgccacaagccttcacggacagcccccattacttcagtaaagcccaaattccttcctcatctgttacctatcttggcatagttcttcatgaaaacacatgtgctctccctgccgatcatatacctggttttgccatcctaacagaaccattatataaactcacaaaaccaaacctagctgaccccatagatcctaaatccgtttgccactcctctttccgttccttgaagacagctttagagactgttcccacactagctctccctgactcatcgcagcccttttcgttacacacagctgaagtgcagggctgtgcagtcggaattcttacacaagagccagaccacaccctgtagcctttctgtccaaacagaaagtaagatattccttgggctggttggtctgaggacctgaggttgtaggtggatcccctcatggagtgagggtgaggacagatgaccggtctcccaaaggagtcctcctgtcctgggttttggcaccaaatgtcacacgcgtccgtgtgaagagaccaccaaacaggctatgtgtgagcaataaagtagaggcctgacacttttgttacaattaatgagccaatataattactttattattaaccaaatgctgggattacaagcatgagccacagcgcctggctggtaatggtattttcaaaaattaggtactgtagaattgtttcatacctggaagttaggttccaatattaaaaaatattgaatttagtaaaaattattcttaaaaaatctgttgacaccaataaaatatatgtataaaaatatatatttgcaatctgttttcttttttgtcaatatgtgtatttaaatttttttaatttaaatccatgcagtatgctagacctccactctggagaagtgggaaaatgcaaatgttaaaaatatatttcattaatatctatttataattttttctggttttgttcaattagcagataactgttacttatttgacaaataaatctagcatacaaacaaagaagaaaagctcttaggagttagaaaaacacactcctctattcccccaaattaagatcacttttactggggcatgaaagtaggtatatctccaaggatcttagtctatagcaataatatttgcacaaatacatgcccccacttagaagggaggaataaaagaccttgcaaaatgatcattaaaaagctggaaactgttttttgaccatgaaatcctgccatcatgaccacattccttatataaagatgaaatatgaatttaatgacttaatagactcaccaaagtcaagaataaaatttcattttgccttcaagatttcatactatccaccgcaagcatctgaagtgttgctcagtctgcagtcattacggaacaggtacacctatcagaccacagtcaagaagctggagaggacggacgctgtagctcacgccta

SEQ ID NO: 466153 - DNA, 1731 bp, Homo sapiens
ggctaattcagaaaggcattgggtgaaagaagattgccacggagacagagagcagcatggtcagtgtggtaggagccggccatcagcgagagctgctccatgcctggctgctgggagctagagcctgcggcccactggcttgcctcactgtagttggtggtggcagtgacagagactgcagcatgaccagagtggcttttctggctttgcccgcccagctgctccatgccaggaggaggaggagacacctagagcctgcaacaccacggctcacctcgctgcgggtgggtggcagtgacggagactgcagtgcgccagagcggtaggagagtggccacgctaggagggcgggcggctgcaggcagggttgggagtcaggcttacagcgatggacgggctgcagcagtggccaggtggtaggagccttgtagggagggctggtgcattggcaatgggcctggctttgccctgtgcctgccgtggatctggccctgtactgccctgccttgccctgtacctgccctactgttacctggactctcagccctgtcctgctctggtcccatcctgaccctgtcttggccccgtgctaccctgtccctgccctggtcttgccctggcactggccctgccctgaacctgcactggcctgaccttggctctggccctggctctggccctgccccttgtcctgaccctggtcctgtcatggcactggccctgccagtggtcatggtcctgctcctgttctggccctgacctggccttggaaatgtcctggctctgctttggcccatccctgccctggccccaccatgggccttcctgccctgcccctgctgctgccctggccctggcctggaacctggtcctgtcaaggacctgccctgactctgccatggccctggccctgctctgccttgttcctggccctgacccagacccagaccctttcctggctctgcactggtctttccctggccctgagctggcagtggcccagcacagacctggctctgaccctggccctggtctttgtcctgccatagctttggccctgaagtggacttggaggtgtcctggccccggtgtaacatggctctgcattggcctgtctctgccctgcccctaccatcgccttgccctgctctgccctgtcccagtactgacccggccacgctatttccccgccctaccctgccttggctatgaccctggccctgcccctgcccttgcccttgccctggcactggccttggacatgtccgtggtcctaaccctggccctgccctggagctgccactgtcttggccctgccctggctctggccctgccccggccctggccctgccccggccccagccatagacctgccctgcacagacctggtcctatctgtggccttggcctggcattgacccctgctcctgaccctggtcctgccatggccctggccctgccaatgaccctggcagcccttaccctggccctgaactggccctgccctggccctgaagtggatttgcaggtgtcttacctggccatggccctgcgtctgccctggaccggcgctggcactggcatggaccctggccctggcccttcactacttaaggccataccctggcccagccctggccctaatttggcctggctctaccctggcatgctattctggccctagccctgaccctgtccctgtccctgtactggtcctagccccgttgctgg

SEQ ID NO: 466154 - DNA, 993 bp, Homo sapiens
attagacagatattagggatgatggttaattacaagcaaggctgctcctatggccaggaataaaaacgcttgtacctacttaacaggctggcatgattcatgtctgggccaggtggattcactaaatgcatccacgaaagagcagattaaggagattgcagaagcaatgcagggccagagaccagggcgtgaaaacggatgcagatcccgcaggctgcagctactgctgcggctcctctcacaggcctggctgggcctcgggaccctccagagcccaaagggctccacaatcacaggaactcattccttaaaaggaaatctctctctctctaaatacagacatacacatgcatcctatcggtctgtttctctggagagccctcatacagtagttacatctttattcttaggaggcgcctgctgaggaatgcaagggtgagttgttttgacgtctgtaactagcttccaaccggttccacgagagaaagcgggcggaggcagagaaatcacaacatgctacgaagcgctggatccagactatggaaatgatgttagacaaaaagccaattcgagtgattttcttttttgagttcaaaatggatcataaagcagcagagacaacttgcaacgtcaacaatgcatttggctcaggaactactaatgaatgtacagtgcagtggtggttcaaaaagttttgcaaaggagacgagaaccttgaagctgaggagcatagtggccggccattggcagttgacaagggccagttgagagcaaccatcaaagctgatcctcctacagctacatgagaagttgccgaagaactcaacatcaaccattctacagttgttcagcattagcagcaaattggaagtgacaaagcttgataagcaaaaatttaaaaaatcattgttttaaagtgttgtctccccttattctatgcaacaatgaaccattttttggttggattgtgacgtgcaacaaaaaatggatttt

SEQ ID NO: 466155 - DNA, 1496 bp, Homo sapiens
ttcctagttcttcagttttggaatttggactggctctcctcactcttagcttgcagacagcctattgtgggaccttgtgattgtgaaacctcacccacctcagcccttattaggcacctaatgtggattctaagacagacactgaaacaaagctgcccctggggaagacgacatgtatccaaatggggagacagactagatggctgatcaagaaggagacagatgccatctggggagggacaggcataagccactttctggtgcttggagttagtgaggaagggctgagtgaaaatgccactctcctgtgcctaccaatattgggtcctgggtcatcatgtgctgggtgccctcagtgaaccaccatgtgatgcagagaccagagagtgaaggcccgggccggcgcagggtggtgcaactttgaatcgaggtggccaagggggagcttttcctgcacaagctctttttgcctgctgccatccatgtaagatgtgacttgcttctcgtcttccaccatgattgtgaggcttccccagccaccaaccatgtggaactgtaagtttaattaaacctctttcttttgtaaatttcccagtctcaggtgtgtctttattagcagtgtgaaaacggactaatatgctccctcttgcagccttgggaatggcctccttgtcagctctcaggaacagtcccagaaatttccaagccgggcgtcgcgcccaccgtattgatgaggggaacggaggctccacggagccgccagaccccgttccccgtgtagtgaagcggcccagctgcctcgctgcccagctgcaggagattgtagctgcgctggagtcagacgctccctcgggcgctgtccatggtggcaggagagtgaaagcagaggaggaaccatcccactggagggtgggggtaggcgctggaatcaaggacaacttcctggaggagggactgtttgaacccaactctgagaacaaggctgccaccctgtcctgtagctataagcagtcctgccagtcagaaccaccacctgagtcagccagcaacggcctcaatgccaaggagaaaaggccacagtcaagctcaggtgcctgcccccagagcagagccctggaccagtggctggacagacacgaggcacgctcaactgtgacccctacgtacgcagcagggcacagctgggccccccagggaccctgggccggctcctccagcccagatgagaaggacagcaaggtgaagtctggggtcctgtgttcctgaggtccaaggtcttgggggtcccctgtttacacactcagttgtgttgttactgacttgtcctaagggcaagctggcccgagtccttagagcttacagccccctggatggctttatcctctgtccagtcttgtactgtggttatttcatggggcaaagtgggcaggagtgggggggactgtgaacttttcccgtggggagagttgaaggtgaggcattaggggggcagtgag

SEQ ID NO: 466156 - DNA, 2649 bp, Homo sapiens
  misc_feature (3)..(5): n is a, c, g, or t
  misc_feature (11)..(12): n is a, c, g, or t
  misc_feature (14)..(14): n is a, c, g, or t
aannnctgtanntntatagagacagggttatcaccatgttggccagctggtggagtgcacttccccggtacactgggtgtcggtgggaaataccagcacttgcgacgagagcattttcctcatttgctctcagccacctggtgccagctttcatcgtccgtgcaggtgaaaggggatctggaggcatcaggttctgcagggcagtgtgccccttgcctatttttctctgcgctgccaaagggacctctacctgtcccactgtgggaggaaagcccctgtctgggctgcctctgctctgggatgaggggactgtgattacatgggcctgtgtcaccttctaccactgggtgaaagaggagaacgatgtgagagactgggagaaggagagaaatctgaacattcaagtcactgagaacgaagtggcagtggagagaagagcagcaatcacagaaatggagcaatgaggaaggaaggaggggatggcatctgtgccaaaagtcagcgggagggcatgcaggagaaggatgggaagtgtctacaactctcatgattctgggtaaaactggagtcctgtgttctagtagtctcaatagagggaagaaggtggaagctagattttaaatggggttgagccagaagggaagttaggagggaaatgaagctatttttagaaatttggctatgaagaagacttgaggtggatagctctctatcttttaaggtgaaaatcatgcaattttgtttatatctcgagagaaagaggctgtgagtgttgctggagggctcaggaaggtctctggatgccagtgagaccccagccccagccggttttccaggttcttgacagcatcacaagaacgaattcaggggggagtcgagtcagaatgaagcgcaaggcgagaagcttccattgcaaagcgaaagtgtgttcttgagaggagcgtagccatgcccgtgagaacaagtcaggcacaacggaggctgggtttcttattttagggatgtttctttctctttctttctttctttctctttctttctttctttctttctttctttctttctttctttctttctttctttctttcttttctttcctttcttttctttctttcttctttctttctttctttctgtcttttttttttgagacggagtctctctttcgcccaggctggagttcagtggcgcgatctcggctcactgcaagctccgcctcccgggttcacgccattctcctgcctcagcctcccgagtagcggggactacaggcgccggccaccacacccggctgatattttgtattttttagtagagacagggtttcaccgtgttagccaggatggtctggatctcctgacctcctgatctgcctgcctcaacctcccaaagtgctgggattacaggtgtgagccaccgcgcccagcccggatgtttctttaataagggggtggaatgctcattaggtattctggaaaaggaggggatttcagggactcctcccccctcctgttattgcctcctttctcccttatttgggtttacctggaagagtcatggccttggtgggtgcaggaagcatagctgtgatgcaagaagcatggccttggtgagtgctggagtatgttctctaaagacactgtgaacactattagcccatactgaaccactgctcctggagaaatacagggttagcttccacgcctctgatcactacatttttgtcatccaaccaatacatatttttgttttatgtgtttttatctacagacaccttgtttaatatacgtttcttaccaatagttaactgtatgtattattctttataataaaactcaagctgggaagagttttgcgttttcctgaccttgggtaatgtgactaaaaatttatttggctgtcagcctcacaacaatgctgtccactaaacttttttttttttagatggagtctcgctctgtcgctcaggctggggtgcagtggtgcaatcttggctcactgcaacctccacctcccgggttcaagagattctcctgcctcagcctcttgagtagctgggattacgcgcaccaacacgcccggctaatttttgtatttttagtagagatgaggtttcaccatgttggtcaggctggtcgcgaactcctgacgtcgtgatccgcctgcctcagcctcccaaagtgctgggattacaggcgagccaccgcgcctggccagtccaccaaacttttaatgtcatctcatgaatccacaaatttcactggttttttttcttcttcttgtttttccataactttaccaggtactatagatgttacttgggcacttttcagagtggcctcacatctgcgtcaatgactttcctcttcctccttctggatgtaacatattgttgactcattgctgttgaacttactgtcaacagcactgtaactcatgcctgagccaagcttgtctaacaggtatattttctctgtaaagcacatcacagcctttctgcacttaggaacattagacagcacttcagcagtacacttgggggccattttaaacaattaaatcactgataggctccgctccgctcagggcggccccagacacgggtttcccatggcagcaccacggcacgcccggcgcacctgctgcccc

SEQ ID NO: 466157 - DNA, 599 bp, Homo sapiens
tcggcacggggccttttaatgacccaggcgtgtgaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgga

SEQ ID NO: 466158 - DNA, 3242 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtttcttaatgcttccaatttcaaaatgtactattgaagaagtggctaagtcacttcttcaaagacattttgaaattggaagaaccaagacagctgcaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaagtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattggtaccaaaatccccaggtgctgaagtctcctgtgataaaatggcatagtatttgcatataacctacatatgtcttcccatatattttaaattatctcttgattacttgtagtaactaatacagtgtaaatagttgttatactgtattgtttagggaataatgacaagaaaaaaaagtgtgtacatattcagtacagacacagttcattcattttttttcctgaatatttttgaacccacaaatggaaaacccatggatacgcagggctgactgtgtatgaagtatttaaatccaaggttttacaaggatgtgaaagcactatttttggggaaaaaaataaacagtatatttgtgctttaggaagaattatcagctatatgcagaatagaattgaggatgattataacaatgataggagtgactataggaaaatagcagtaaggtatcttgggctgctgtgggttgaggcagaggaaaattgagtggacaggtctccaggctttcctgcttggacagagtagatgcactttttattttatccatattaagatactttgaatatgaaaaacatgattagctgctaaaataaaagatttttaaaacatgtatccacaggattctatacttaatcaaagtaatatgtatcagaaacaccatcttcctcaagtttgttatgctgtattggcagtctttttaagtccagagtttctctttaacattttctctgtaaactttattttctgtgtcaccatctttaatgcagctctatttttggtgctcagtgaatttagttattacttctgaatttctaaaatgaatgatttagtattttagattacaaatccacaaagtatattacattagatttacatttacagtatgatataattaacatattggccctccagtttgaagacatacattaatctattactatcttgaccataaaggaacagcattattgtaacccatgtaaaaagtcagatgttgaatagaactttttcttggcacacaggggtgaatgaattcgcttcagcataatggagtggttgagagcatgagctttcaggacagactacctgggtttcaatcttaacttccctgcctttgcccatatgcaggttacatgattattctatgcctcaatttccttctctgtaaaaataacaattcctcccaaacagtacggctgagaagattaaatgagttaatacatataaagctcttagaacactgcctcacatatagtaaatatgcagtaagtactgctgttggtatccttctagtggcaaaattagtctaaccaatgtggttaactaacccaatgttgttaacactggagaatgtctaacataattgttttcttttattaaaaagttattaaagtttacattgaattaagttctgacaagaaacagctgacaaccaaataaagaccagcaatgagatgcttaaacctaaaacattattccataagtgaattaaatggagagacaaattctttacccttttgaaaagaaaaccagtatggctctttgaaaagaattaagttctgacaagaaacagctgacaaccaaataaagactagcgaagagatacttaaacctaaaatgttattccataagcaaattaaatgaagagacaaattccttacccttttgaaaagaaaaccagtatggctctttgaaaagacattggcagactaatggaaaactttagcgataagaaattataattgaagcaaactatactgtgaatcatttttaagggaactatgtctaagaagttttttgctacctttagtatccattttacccatttttctcttttattagttaggttgagccatattaaataacagtttttttgggtcaaaactggttgaatatcagcagt

SEQ ID NO: 466159 - DNA, 512 bp, Homo sapiens
ctcagctatttacagtgtacatggctgagcatgcactatttatagttacaaagatacctgccagtttattacaatagaattacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgga

SEQ ID NO: 466160 - DNA, 1036 bp, Homo sapiens
  misc_feature (746)..(746): n is a, c, g, or t
  misc_feature (749)..(749): n is a, c, g, or t
  misc_feature (1036)..(1036): n is a, c, g, or t
ggacgcgtggtcgaccacgcgtccggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgatanganagggagagggagctcttcactgggacatccacagaaaaagcaacgcagagccggggagatactctacggacggaaccgaggatagaaagagataaggagactcaggaaaactataacggcaaaaggaaaggtacctgaagcaaagaggtacacgagagcggagaatgggactataattccggttaggactgattaaagagagggagccggccaaaaagaaacacagacaggcacagagagacacaaaaaaagacgagtgttatctataacaccacaaagtaaaggan

SEQ ID NO: 466161 - DNA, 5293 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtttcttaatgcttccaatttcaaaatgtactattgaagaagtggctaagtcacttcttcaaagacattttgaaattggaagaaccaagacagctgcaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466162 - DNA, 3744 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgga

SEQ ID NO: 466163 - DNA, 5181 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466164 - DNA, 5479 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattttgttttaagagatggcagctggccgggtgcagtggctcacgtctgtaatcccagcactttgggaggccgaggcaggtggatcacgaggtcaggagttcaagaccagcctggccaagagggtgaaaccccatctttactaaaaatacaaaaaaaaaaattagctgggtgtggtggtgggctcctgtaatcccagctactcaggaggctaaggcagagaatcatttgaacccaggagacggagtttgcaaagccaagatcgtgccactgcactccagcctgggcaacagaaggagactccgtctcaaaaaaaaaaaaaagatggcagctatataaatgataaaattaattacattctctttcacatgcatgaggtgcaaactctgtcacaagtattttaattaccttttaccttgtttcatagatctttatgtgacataaaaacagtttctggcacggtggctcacgcctgtaatcctagcactttgggaggctgaggcaggtggatcacctgaggtcaggagtttgagaccagcctggccaatatggtgaaaccccatctctacaaaatttgcaaaaagtagatgggtgtggtagtgggcgcctgtaatcccagctactcaggaggttgaggcagagaatcgcttgaacccggggggtggaggttgcagtgagctgagatcgcaccactgcactccagcatgaaagagcgagactcaatctcaaaaaaaaaaaagtttctggcacctgaacaggaactggtttccatcatcaactcagaaagcactaaaatctaggtggtgattcagggaggagcaggggaagacagcctcctatggtggcatgaataagatgcttccagaactagtagggaaataactaacctcttcaggctttatcaggcctggaggggaaccttgctcatgttagcaagaaaggtatcctagagaagccactcaaaaggctccctaatccagcctgtctccacatacatactgaaaattcttccctactctgaggcagggtgtagtggtttaggggtttctccagactggaatcctacctatctgtaccgacaattgagcaaacaacagttgagagagtccaaaaaaaaaagtattaaaatgtgattgatgtaatttaccatgtttactttatgcatgcattttattggggaggggaggtcagaataattcacccaaatctagtggtcttatttcataggctaatctggtttatattggggtgtttacagtctttcatcataataatttctggcg

SEQ ID NO: 466165 - DNA, 5315 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaaaccaccattctgctcaagaaatataacattactca

SEQ ID NO: 466166 - DNA, 5214 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcacatatatacaagtcgagcggccgcgaattagtagtagtaggggccgc

SEQ ID NO: 466167 - DNA, 4181 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggaaaaaaaaaaaaaaaaaaaaaaaaaaaaaaaaaaaaaaaaaaaaaaaaaaaaaaaaaaaaaaaaaaaaaaaataatacatacaaacgaaaataaaagctaacttgaccaattcgccctatggtgaggggtattacaatttactggccgtcaatttacaacttgggtgctgggcaacccctggcgttccccaattttatggcctggcattatatccccctctcgccaggttcctttttttgccgaataggcccgtagggacggccttcccaacagttgccccgctctttatgccatgggtatttgaaggcccctctttttccccgcggccacatcccttctttttctaataaatggcccgaaatatgggtgagtggtcgctccgctcggaacatttgttcaaatttaaggaacgttttcttatcacacaggttattact

SEQ ID NO: 466168 - DNA, 5235 bp, Homo sapiens
cccgagaacgaacttacggtctaggtacgaggctgggtggtgaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466169 - DNA, 4197 bp, Homo sapiens
ctgtagatgacagtcggccatgtggaacctcactagaagtgcgcctgggtgcgctgagatgacagtcggccacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466170 - DNA, 4430 bp, Homo sapiens
  misc_feature (276)..(276): n is a, c, g, or t
actctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagncaaataccaagcaaaatagtgtgcctccttcacagatttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466171 - DNA, 4034 bp, Homo sapiens
gagtggaatcaaatggctaataaattttctggaatttcttagaaattccatttaaccatatgatatgcttagcagaaattgaataaagattgttaccttcatgttatttttttttctggctcttaaaatgtgcttgggagacagaacaataacttaaaattacagcttagttgaacataaggaatttttagtttttgccttttaatttatggcaaaaatgatagacgcctaattcacactgttaaattttagatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466172 - DNA, 3101 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagaggctgctacacactgccatacagtcaaccatcatacttcatatttgcatactcgatagcagcctatttctactgaacctgtcac

SEQ ID NO: 466173 - DNA, 3788 bp, Homo sapiens
  misc_feature (86)..(86): n is a, c, g, or t
ccctctttctaccacgaggacacaatgagaagtcagcagttctgcaacccagatcagggtcctcaccagcacctgaccatgaggcnaccccgaccttggacttccagcctccagaactgtgagaaacaaatttctgttgtttatcagccacatactctatggaaattttttatagagagagttttctcaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466174 - DNA, 3763 bp, Homo sapiens
  misc_feature (140)..(140): n is a, c, g, or t
aaccagtgttagcttgcctctgggtgggtgagcttgaagtcctctgggacagagacctgtctccacgcctccgggagctgtgtccctgagccccctagtcctggctcctgctttttccccacagcccgtgttcccagccngaaccagcactctcccggaagcctggggtccctccacaccttggcttttatgaccctgatggcttctgaaacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466175 - DNA, 3357 bp, Homo sapiens
  misc_feature (70)..(70): n is a, c, g, or t
aatacgcactgactttccacgaaagaaactttgggccttcccatctgactcttcaagagacttgccaagncaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466176 - DNA, 3099 bp, Homo sapiens
cgagcggccgccgggcaggtgtttaacaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466177 - DNA, 1885 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacagacacagaagaattgaaaagagattgagaagactttcagtgatactctaaaaccgtcaaaaagaaaagttttcctgagaacctagataagggttcgcgagtatgtaaataggaggtatagatgtcactgtattacggcactgttttcaagggttgaaaggttccaagggaataagaagagatcggattagaaaaaaaaaatgggggcaatatatgggggaaagataagggtggtaaacgggaagtgataacagc

SEQ ID NO: 466178 - DNA, 1975 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaagtatgtccttttaaaaattatcagttattttttttcagagttttctttctagcaccctgaattcatgctttatgttttaattttaattctaatttctcacctttaaaggtcataagaatataatttaataccaaatgtactacttgaaacctgattattgaatacctgtagaattaaaactgaattttcgtaattgaggcaatatttaaacaaagttttcttctagttgctctgtagtatttctagtttttaaattttttgttttaaatgaatgtctgtttctcctcctaggtagtataatagactgaattaaatatacagaaatggctttgtatttgtgaagtatacacacatttttgtgccggtagaaaactactttcttaacccagttgccagtagaagtttagttaaaggaagacattttagaagggaagaatatggtttgtatgttcggaaagctcatgccgtcttcattta

SEQ ID NO: 466179 - DNA, 1996 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtgagtataagagattcctgggtgtttatttgttaatgaaagagacaggctgggcacggtggctcgcgcctgtgattccagcactttgggaggtactgtgggaggattgcttgagcccaggagttcaaggccagcctgggcaacatagcgagaccccgtctctatttataaaaataaaataaagcaactgaaggagaattctgggtcacagaggctgacaccaattgagagcctcagggagacaataatagcatcagaaacagcaaacccaagttttgataggactggaggagagatagtggataatagcaacacgtggtatcaggaatggttttgctagggttggggtgttgtattttaatgatagggagat

SEQ ID NO: 466180 - DNA, 1718 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgtggtaagaagtgttagaaaaatttaactttatttaaaattactaatcttgtacatttttaatttttcagaaatagaaaaaaaaactatgaatagaaaaataagtactgctctgcaggaaagaggaaaactgagccatctgcctggagtcaagacactggagatgctaatacaaatggaaaagactggggaaggagttggagtgaccgttcaatattttctggcattggtaagaagtgttagaaaaatttaactttatttaaaattactaatcttgtacatttttaatttttcagaaatagaaaaaaaaactatgaatag

SEQ ID NO: 466181 - DNA, 992 bp, Homo sapiens
  misc_feature (841)..(842): n is a, c, g, or t
  misc_feature (850)..(850): n is a, c, g, or t
  misc_feature (854)..(854): n is a, c, g, or t
  misc_feature (857)..(857): n is a, c, g, or t
  misc_feature (862)..(862): n is a, c, g, or t
  misc_feature (872)..(872): n is a, c, g, or t
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagcagtcanngaccatangagnaancaagncagtgctaangcggcaaaccagctccgcctgatggaggagttgtgaggagctggaactaattgtccaggggaacggaggcggtacgggagggggccggctggccgggcaccactccgggaaaaaccacgc

SEQ ID NO: 466182 - DNA, 605 bp, Homo sapiens
  misc_feature (6)..(6): n is a, c, g, or t
  misc_feature (34)..(34): n is a, c, g, or t
ggaacnctgcgacttttcactacaggaaacatgntctttacccttgcgatgtgggaaaacccctttcgacttattactatgagatagacacatcattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgga

SEQ ID NO: 466183 - DNA, 2440 bp, Homo sapiens
caggtatatactccccccccttgtgggggctggtggcgccgagggggccccttgggccccgggtttgggggcccccctccccaaaaaaaaaaaaaaaaaaaaaaaaaaaaaaaaaaaaaaaagatggcagctatataaatgataaaattaattacattctctttcacatgcatgaggtgcaaactctgtcacaagtattttaattaccttttaccttgtttcatagatctttatgtgacataaaaacagtttctggcacggtggctcacgcctgtaatcctagcactttgggaggctgaggcaggtggatcacctgaggtcaggagtttgagaccagcctggccaatatggtgaaaccccatctctacaaaatttgcaaaaagtagatgggtgtggtagtgggcgcctgtaatcccagctactcaggaggttgaggcagagaatcgcttgaacccggggggtggaggttgcagtgagctgagatcgcaccactgcactccagcatgaaagagcgagactcaatctcaaaaaaaaaaaagtttctggcacctgaacaggaactggtttccatcatcaactcagaaagcactaaaatctaggtggtgattcagggaggagcaggggaagacagcctcctatggtggcatgaataagatgcttccagaactagtagggaaataactaacctcttcaggctttatcaggcctggaggggaaccttgctcatgttagcaagaaaggtatcctagagaagccactcaaaaggctccctaatccagcctgtctccacatacatactgaaaattcttccctactctgaggcagggtgtagtggtttaggggtttctccagactggaatcctacctatctgtaccgacaattgagcaaacaacagttgagagagtccaaaaaaaaaagtattaaaatgtgattgatgtaatttaccatgtttactttatgcatgcattttattggggaggggaggtcagaataattcacccaaatctagtggtcttatttcataggctaatctggtttatatttgcattaaagatactggagggcaatatttacagagtttagtttttcttaattaaaaacagtcctctattaatatagtgtgaaatatctttcaaaatttagagtttaggtttaagatgtctactagatatctttaagattttcctgtaaactcactgcacaaactggaattactttccaaaagacttagggaatgcaaatatgttactcataagatgcattgagtattgtaaataaaacaaaccatttttgatttgtttaaattgctcgttacagttctcttgtggggagggactttgtcagtcattttgcatcttaagctagactaaactttttgttgttgttttcctaaaaccataggtgcaagctttgccgctgggaagtcatattgaattaagcacttttgaaaatgtcactgtttgtgacacacaatgttctctacagaaaacttcttctatcttatgtcattttagcagtagatgtagctgcctgccaccaggtgcaatatgtcatttgcatcagccttttcagttaaggaaattaaaacttggcatgcattagttcatatgtatgaggttggctgtgtccccaaacagcaattgcttgtacaagatagaagtttgcttctcagctgggcatggtggctcatgcctgtaatccaagctctttgggaggccaacgcgggaggattgtttgagcccaggagtttgaaaccatcctgagcaatagagagacccccatctcgacaaaaaaaaaaaaaaaaaattagaaacaaaaaaaagattgtttctctttcatattaaagtttgggaaggcaatccagagcccatatgacattatgcagggtcagggatccgggttctttctatattgttcctccccattctcaacctgtagctttttttttaatctcctttctaaagtggaagatgcgcgacccagaggggaggactccggtctcaaaaaaaaaaaaaaaaaaaaaaaaaaaaaaaaaaaaaaaaaaaaaaaaaaaaaaaaaaaaaaaaaaaaaaataatacatacaaacgaaaataaaagctaacttgaccaattcgccctatggtgaggggtattacaatttactggccgtcaatttacaacttgggtgctgggcaacccctggcgttccccaattttatggcctggcattatatccccctctcgccaggttcctttttttgccgaataggcccgtagggacggccttcccaacagttgccccgctctttatgccatgggtatttgaaggcccctctttttccccgcggccacatcccttctttttctaataaatggcccgaaatatgggtgagtggtcgctccgctcggaacatttgttcaaatttaaggaacgttttcttatcacacaggttattact

SEQ ID NO: 466184 - DNA, 405 bp, Homo sapiens
tgttatgttcaagcctcctgtttttaaattaaggcaatccttggtgatcaaaggatagtaggggaagtgagtaataaatataagtcaagcaatcatagaaatgtgaaaatatcccagttttaagaagtcatgtacctgttttttaatattcattttcttttctttaagtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattg

SEQ ID NO: 466185 - DNA, 970 bp, Homo sapiens
  misc_feature (819)..(820): n is a, c, g, or t
  misc_feature (828)..(828): n is a, c, g, or t
  misc_feature (832)..(832): n is a, c, g, or t
  misc_feature (835)..(835): n is a, c, g, or t
  misc_feature (840)..(840): n is a, c, g, or t
  misc_feature (850)..(850): n is a, c, g, or t
attacggctaggtagaggctgggtgtgaatcggccgagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagcagtcanngaccatangagnaancaagncagtgctaangcggcaaaccagctccgcctgatggaggagttgtgaggagctggaactaattgtccaggggaacggaggcggtacgggagggggccggctggccgggcaccactccgggaaaaaccacgc

SEQ ID NO: 466186 - DNA, 5280 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466187 - DNA, 6837 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattttgttttaagagatggcagctggccgggtgcagtggctcacgtctgtaatcccagcactttgggaggccgaggcaggtggatcacgaggtcaggagttcaagaccagcctggccaagagggtgaaaccccatctttactaaaaatacaaaaaaaaaaattagctgggtgtggtggtgggctcctgtaatcccagctactcaggaggctaaggcagagaatcatttgaacccaggagacggagtttgcaaagccaagatcgtgccactgcactccagcctgggcaacagaaggagactccgtctcaaaaaaaaaaaaaagatggcagctatataaatgataaaattaattacattctctttcacatgcatgaggtgcaaactctgtcacaagtattttaattaccttttaccttgtttcatagatctttatgtgacataaaaacagtttctggcacggtggctcacgcctgtaatcctagcactttgggaggctgaggcaggtggatcacctgaggtcaggagtttgagaccagcctggccaatatggtgaaaccccatctctacaaaatttgcaaaaagtagatgggtgtggtagtgggcgcctgtaatcccagctactcaggaggttgaggcagagaatcgcttgaacccggggggtggaggttgcagtgagctgagatcgcaccactgcactccagcatgaaagagcgagactcaatctcaaaaaaaaaaaagtttctggcacctgaacaggaactggtttccatcatcaactcagaaagcactaaaatctaggtggtgattcagggaggagcaggggaagacagcctcctatggtggcatgaataagatgcttccagaactagtagggaaataactaacctcttcaggctttatcaggcctggaggggaaccttgctcatgttagcaagaaaggtatcctagagaagccactcaaaaggctccctaatccagcctgtctccacatacatactgaaaattcttccctactctgaggcagggtgtagtggtttaggggtttctccagactggaatcctacctatctgtaccgacaattgagcaaacaacagttgagagagtccaaaaaaaaaagtattaaaatgtgattgatgtaatttaccatgtttactttatgcatgcattttattggggaggggaggtcagaataattcacccaaatctagtggtcttatttcataggctaatctggtttatatttgcattaaagatactggagggcaatatttacagagtttagtttttcttaattaaaaacagtcctctattaatatagtgtgaaatatctttcaaaatttagagtttaggtttaagatgtctactagatatctttaagattttcctgtaaactcactgcacaaactggaattactttccaaaagacttagggaatgcaaatatgttactcataagatgcattgagtattgtaaataaaacaaaccatttttgatttgtttaaattgctcgttacagttctcttgtggggagggactttgtcagtcattttgcatcttaagctagactaaactttttgttgttgttttcctaaaaccataggtgcaagctttgccgctgggaagtcatattgaattaagcacttttgaaaatgtcactgtttgtgacacacaatgttctctacagaaaacttcttctatcttatgtcattttagcagtagatgtagctgcctgccaccaggtgcaatatgtcatttgcatcagccttttcagttaaggaaattaaaacttggcatgcattagttcatatgtatgaggttggctgtgtccccaaacagcaattgcttgtacaagatagaagtttgcttctcagctgggcatggtggctcatgcctgtaatccaagctctttgggaggccaacgcgggaggattgtttgagcccaggagtttgaaaccatcctgagcaatagagagacccccatctcgacaaaaaaaaaaaaaaaaaattagaaacaaaaaaaagattgtttctctttcatattaaagtttgggaaggcaatccagagcccatatgacattatgcagggtcagggatccgggttctttctatattgttcctccccattctcaacctgtagctttttttttaatctcctttctaaagtggaagatgcgcgacccagaggggaggactccggtctcaaaaaaaaaaaaaaaaaaaaaaaaaaaaaaaaaaaaaaaaaaaaaaaaaaaaaaaaaaaaaaaaaaaaaaataatacatacaaacgaaaataaaagctaacttgaccaattcgccctatggtgaggggtattacaatttactggccgtcaatttacaacttgggtgctgggcaacccctggcgttccccaattttatggcctggcattatatccccctctcgccaggttcctttttttgccgaataggcccgtagggacggccttcccaacagttgccccgctctttatgccatgggtatttgaaggcccctctttttccccgcggccacatcccttctttttctaataaatggcccgaaatatgggtgagtggtcgctccgctcggaacatttgttcaaatttaaggaacgttttcttatcacacaggttattact

SEQ ID NO: 466188 - DNA, 5232 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466189 - DNA, 4689 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466190 - DNA, 4990 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattttgttttaagagatggcagctggccgggtgcagtggtcatgcctgtaatccaagctctttgggaggccaacgcgggaggattgtttgagcccaggagtttgaaaccatcctgagcaatagagagacccccatctcgacaaaaaaaaaaaaaaaaaattagaaacaaaaaaaagattgtttctctttcatattaaagtttgggaaggcaatccagagcccatatgacattatgcagggtcagggatccgggttctttctatattgttcctccccattctcaacctgtagctttttttttaatctcctttctaaagtggaagatgcgcgacccagaggggaggactccggtctcaaaaaaaaaaaaaaaaaaaaaaaaaaaaaaaaaaaaaaaaaaaaaaaaaaaaaaaaaaaaaaaaaaaaaaataatacatacaaacgaaaataaaagctaacttgaccaattcgccctatggtgaggggtattacaatttactggccgtcaatttacaacttgggtgctgggcaacccctggcgttccccaattttatggcctggcattatatccccctctcgccaggttcctttttttgccgaataggcccgtagggacggccttcccaacagttgccccgctctttatgccatgggtatttgaaggcccctctttttccccgcggccacatcccttctttttctaataaatggcccgaaatatgggtgagtggtcgctccgctcggaacatttgttcaaatttaaggaacgttttcttatcacacaggttattact

SEQ ID NO: 466191 - DNA, 3558 bp, Homo sapiens
  misc_feature (3544)..(3544): n is a, c, g, or t
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgactgttcatataatnggttcctgccgcta

SEQ ID NO: 466192 - DNA, 4602 bp, Homo sapiens
gaaagaggaaaactgagccatctgcctggagtcaagacactggagatgctaatacaaatggaaaagactggggaaggagttgggggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466193 - DNA, 4165 bp, Homo sapiens
ccgccggctctagaggaccccttcgattggcgggcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466194 - DNA, 4143 bp, Homo sapiens
taaattcgcggccgcgtcgacgtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattcttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaa

SEQ ID NO: 466195 - DNA, 2469 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagcctgtgtaagctattataattaaaatggttttccggaaaaaaaaaaaa

SEQ ID NO: 466196 - DNA, 1930 bp, Homo sapiens
  misc_feature (1640)..(1640): n is a, c, g, or t
  misc_feature (1643)..(1643): n is a, c, g, or t
  misc_feature (1930)..(1930): n is a, c, g, or t
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgatanganagggagagggagctcttcactgggacatccacagaaaaagcaacgcagagccggggagatactctacggacggaaccgaggatagaaagagataaggagactcaggaaaactataacggcaaaaggaaaggtacctgaagcaaagaggtacacgagagcggagaatgggactataattccggttaggactgattaaagagagggagccggccaaaaagaaacacagacaggcacagagagacacaaaaaaagacgagtgttatctataacaccacaaagtaaaggan

SEQ ID NO: 466197 - DNA, 1578 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccattcccagccacatggcagagaaaaaaatcataataaaatggctttattttctggta

SEQ ID NO: 466198 - DNA, 1829 bp, Homo sapiens
gtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgtggtaagaagtgttagaaaaatttaactttatttaaaattactaatcttgtacatttttaatttttcagaaatagaaaaaaaaactatgaatagaaaaataagtactgctctgcagaaataatagtaataattaactcatctcacatcctttttgtagagcaaggtgggaattaaataagtaaataacatcatttactctttacatagtgctttcacatactttatcacatttgattatcaacatagctaactggtgtaattatatattcttagtgatgtgatacatgtaatgtgtgggtagactttttgattaatttcaacaattctgttgagtctaaataaaaatagtaaatggaagtacagttgataacatccacttatattttacagttgcacttcagcctgggtgacagagtgagatcctgtctc

SEQ ID NO: 466199 - DNA, 719 bp, Homo sapiens
gacaatgtttatgtaagcagcagaaatgccttttacctcccactgtgattctgaggccccctcagccatgtggaattgtgaatacttggcaggacaacaggcagacaaggagcagcctgggctacaccctcctccatccagcttggcagggaaggtcttggtgcctcagttgaaacttccaatttaacatcctgacacacactactccctcttcctgtgatcatcagaacaagataaaaccttgtgtgtctggatagttctcatctgttaagattcaggtaaagaaacgccttctttgggaagttgtttatatcctcttccatcagactgagctaattattcctcttcaaacccacacagtgttccatgtaaactattatagtctttgctacactgagtcactctggaatcagatgccaagattcaagtcttcctttcacgaactatatgatcttggggtattcttccccttttagagcctgagttttttaaacttaccttttggagtttttgtcagaattaagttagatgattttaaggtatattaagttcttagatcagtccctgagagaactgaggtgacatttattttgtcactgaacatctgtatgtgtttggggagaaaggaagtgtgggctatattctggaaggacaagacagcagtgtgttaattattatgtaaggagtgagaaatgtcatatgtttttcttaaaatttct

SEQ ID NO: 466200 - DNA, 1601 bp, Homo sapiens
tctgtggattctttcagctttcctggtatgttcttgtggcagttcttagagcaaaagttcatggtgtgtgtctacacatgccactctgtccgacctagtgggggctgcaagttagttttgcctcctatccgccattttccctctattggaagtacacttgaagtgagagtacctttggaaaagattggtgactcttggaactgggtgcctggaaaagccatggacactcaatgccagcccatgaatgcagcggggagggaggctgtaccctgcaaagccacaggggtggagctgcccaagactatgggaacccacctcttgcatcagcatgacctggatgtgagacctggagtcaaaggagatcatcttgcagctttaagatttgactgccctgcttgatttcagacttgcatggggcctgtagcccctttgttttggccaatttcccccatttggaatggctatatctacccaatacctgtacccccattgtatctaggaagtaactagcttgcttttgattttacaggctcataggaggaagggacttgccttgtctcagatgacactttggacttttgggttaatgctgaaaagagttaaactttgggggactgtagggaagacatgattggttttgaaatgtgaggacatgagatttggaggggccaggggtggaatgatatggtttggctctgtgtccccacccaaatctcaacttgaattgtatctccaataattcccatgtgttgtgagagggacccagtgggaaataatttgaatcacgggggcagttcccccatactgttctcatggtagtgaataagtctcatgagatctaatggttttataagggttttctgttttttcatcttcctcgtcttctcttgctgctgccatataagaaatgccttttacctcccactgtgattctgaggccccctcagccatgtggaattgtgaatacttggcaggacaacaggcagacaaggagcagcctgggctacaccctcctccatccagcttggcagggaaggtcttggtgcctcagttgaaacttccaatttaacatcctgacacacactactccctcttcctgtgatcatcagaacaagataaaaccttgtgtgtctggatagttctcatctgttaagattcaggtaaagaaacgccttctttgggaagttgtttatatcctcttccatcagactgagctaattattcctcttcaaacccacacagtgttccatgtaaactattatagtctttgctacactgagtcactctggaatcagatgccaagattcaagtcttcctttcacgaactatatgatcttggggtattcttccccttttagagcctgagttttttaaacttaccttttggagtttttgtcagaattaagttagatgattttaaggtatattaagttcttagatcagtccctgagagaactgaggtgacatttattttgtcactgaacatctgtatgtgtttggggagaaaggaagtgtgggctatattctggaaggacaagacagcagtgtgttaattattatgtaaggagtgagaaatgtcatatgtttttcttaaaatttct

SEQ ID NO: 466201 - DNA, 988 bp, Homo sapiens
gactgggatcagtcgctaaggccgatggcagggcaggaaagatcactagatgcaggcagggtccgggggcagaggcccctgtactggggccagtctcacagctccaggctccatcatctttactgccgacccagcaatctcctttcctgtagctccagcccaagcctgggccctggctcttcctggactcaattgggtcaggggaccatccctgagccaatcgctggcactgggaggctgtggcatttcaattggccaggcttgtatcaagcacctaggggtggagttgccctgtcctcaccgcagggaagcaaagcctccaagtgccattgtgtctcctgggctgggcaagcgcatttcatctcctctgcaccaaaaacagcctgaggacttgtgaactggtctggaagtcgagagctcttttttgatttcatcattaaattgctttgcaaaaagggacactttctggtttaatttcttctgtcactaatactgaatcatgtgtagctgtccaaaagaaaaaaggatctgttgttgctattccttgtcaaacataaagttatggtttaaattcagtgaagttttttgagcagctgaggtcacctcttagttggtagaataattttgccatttttcaacctgtgtttcacacaaggttattaaaggaaaagtgctaacaactttgaaatgagaagctggaagtttaaacgtgtttgtcttgagtcatagcataaggcacagttgcaatgctttgctctctgtgtcttatcacttagaccacattcttatttttgtacttccactcaccttgaccagagtagaggatcacataaagggtatattttccaaataaagctgtttggatcatcatagttttaacaaagacaatccctaacatctgtagagtgcattctccacactgctgccagggttgtttgactaagtccctaagacaagttcttagcacgttacttggttgctttaaaaa

SEQ ID NO: 466202 - DNA, 2438 bp, Homo sapiens
gcactgcacgggacgatgtcctgcacaccgggcacacctagggctttgcatccacaccagtattgcttccttagatcctcacagctgccagtccagagtttcccaaagtaccctcaactggtcactgccgctgcactgggcgggcaggacgaggagccgcaggccccaggctccacctcagaccctcaatctgaagctgcaaggtggggccccggggctcctgcacctgtccactgtgagggtcccaggctccaagctccggcatcctctggcatccggtgccctgcagaccaccatccctatagaaccctggccctacagatccccagccctataaacctgcagtcctacagatccctggctctgcagagcctggtcctgtggaccgagcacagtacggatggaggggaggtctgggtgaggggggcgcccttgggagacgcacagacggcacacggccagcaagctgaggtgccctccccaccccacgaccaccattaatgctgaaatccaagaccctgggctcgaggacgcagaacgactcgtggtttgcaaagtgtggcacccccagacgctccagcatccgcgtggtctgggaactgacttcgttagaaatgcagtttcctgggcccacccaaggcctcctgagtcagaaacaatctgtgccttaagagaggcctcggggggattctggggcctggtaaagtttgggaactgctggtctacaccatgaggagaaacgctggacccggcctaagaagaggccctccctcctgtctgacaatgagccatgagaagaccatgggaaaaaaaagaggccaccagaaaccctattgccgaggtcctggcaaggaagaaaaggacagaagagctaatttccctacaagaacacgggtctaggaaacagaaaataaaggaagcttccatttcatgggcagagacatctcggcaaataggctgagcccatgtccccagagctctgagtaattaaattttgagaaaagtgggtcaggctgtggttccatttcttaggtctgagtcatcaaaggatggtgacatttactgctaatatgagattgtgccctcccgattaacggtgggtctgccttccccagcccactgattcaaatgttaatctcctttggcaacactctcatagacacacgcaggattaatacttgtatccttcaatccaatcaaattgacactcagtagtaaccaccacaagggccgctgtgggctccgcctgcaggatcgaggcacatccaccagccaggccagaaactttaaaaccgacacttggcaaagcactgagagagagcagacgagtcaattatatgggagaatgtaaatagaggagaagcgggagccataatgtaacatcgccctcccgggagtttaaaaagacatgaaattgtcggatccagctggacccggcttgccctgcggcagaacccacagcctcacgctcaaccggcaggttccacgtgccatctcctcctctcccgtccagctggggccgggtcacggtaaggagagaaacgtcgccctgccacgagctcctcaaacacaccaggccctgcacgtggagtcagccagggacacccatgtgaacgcagaaggagggaagagagcaagattaaagccagaggtggaggaggaccccacgaaggagggtcatttctgcaataaaaggaaggagaagagaaggagggaaggccagtttcacatcacctcctccaggaagctccccagctctccccagtgcaattaaccctcccagactgtcggatgcaagacccagcacatcccatggagggccctgagtaaaattcacaatggtctgcctgtcagactgtgagctcctggaaggaaacgaggggtcccatcccatttgcctcggtctccccaagataggcccgacccaggtgaaaaggcaaaagccttcagggtccaggcaggttatgctgatgtgcagagaggcctgggaagtggtggagactgtggctgctgcatccctcttgaaggcactggagtaaaaagagaagggatggagggacaaagggaaggaaggaaggggatgggagagagggagggaggaagagagggaggaaagaaggaaggagggaaggatggagggggaaggagaaagaaaggaacttaaaagctgtgttggccaaatggaatggctctgctcccaggaccctgtttggactgggcccccaggccaggactatagctcagggccctggccttctccccggggagagctgataaaccgatgggaagtgagaagagggaactgtgacaagtcaaagagtgaccatgccaggcgaagggccgttgctggcttagggccccacagcaggaatggaagacatctgcctggcatccctgccccctgactcctaggctctgtcccttctcaggcccgggtg

SEQ ID NO: 466203 - DNA, 1766 bp, Homo sapiens
tatagtaggatgatttataatcctttgggtatatacccagtaatgggatcaccaggtcaaatggtatttctggttctagatccttgaggaatcaccacactgtttttatgtcattttgtggcatttatttacagaaaaaaaagaggccaccagaaaccctattgccgaggtcctggcaaggaagaaaaggacagaagagctaatttccctacaagaacacgggtctaggaaacagaaaataaaggaagcttccatttcatgggcagagacatctcggcaaataggctgagcccatgtccccagagctctgagtaattaaattttgagaaaagtgggtcaggctgtggttccatttcttaggtctgagtcatcaaaggatggtgacatttactgctaatatgagattgtgccctcccgattaacggtgggtctgccttccccagcccactgattcaaatgttaatctcctttggcaacactctcatagacacacgcaggattaatacttgtatccttcaatccaatcaaattgacactcagtagtaaccaccacaagggccgctgtgggctccgcctgcaggatcgaggcacatccaccagccaggccagaaactttaaaaccgacacttggcaaagcactgagagagagcagacgagtcaattatatgggagaatgtaaatagaggagaagcgggagccataatgtaacatcgccctcccgggagtttaaaaagacatgaaattgtcggatccagctggacccggcttgccctgcggcagaacccacagcctcacgctcaaccggcaggttccacgtgccatctcctcctctcccgtccagctggggccgggtcacggtaaggagagaaacgtcgccctgccacgagctcctcaaacacaccaggccctgcacgtggagtcagccagggacacccatgtgaacgcagaaggagggaagagagcaagattaaagccagaggtggaggaggaccccacgaaggagggtcatttctgcaataaaaggaaggagaagagaaggagggaaggccagtttcacatcacctcctccaggaagctccccagctctccccagtgcaattaaccctcccagactgtcggatgcaagacccagcacatcccatggagggccctgagtaaaattcacaatggtctgcctgtcagactgtgagctcctggaaggaaacgaggggtcccatcccatttgcctcggtctccccaagataggcccgacccaggtgaaaaggcaaaagccttcagggtccaggcaggttatgctgatgtgcagagaggcctgggaagtggtggagactgtggctgctgcatccctcttgaaggcactggagtaaaaagagaagggatggagggacaaagggaaggaaggaaggggatgggagagagggagggaggaagagagggaggaaagaaggaaggagggaaggatggagggggaaggagaaagaaaggaacttaaaagctgtgttggccaaatggaatggctctgctcccaggaccctgtttggactgggcccccaggccaggactatagctcagggccctggccttctccccggggagagctgataaaccgatgggaagtgagaagagggaactgtgacaagtcaaagagtgaccatgccaggcgaagggccgttgctggcttagggccccacagcaggaatggaagacatctgcctggcatccctgccccctgactcctaggctctgtcccttctcaggcccgggtg

SEQ ID NO: 466204 - DNA, 795 bp, Homo sapiens
tattagtttgataaggctagtataatgaaatattgcagactggctggcttaagcaacagaaatttatttgctcaaagttctggagtctggcagtccaatatggaatgtttcaatgaagacgcagctaaggcaccaacttgggacagtgccttgcaagaatacggaactgttattcaggatgcagtatatgcattggatcagggatgtttatgcagtgctttgccactaacacgaaaaatacatgggtccatggaccaagaagatggaagcagaagtgaccccacttatcatcactgtcagacccacttggtgcctcttggtacttccttgtccaactatggctatgaatggacaaacatcacaactaaagaagagtacggttacaaaaacacagatctgtgaggaatgagggtttgggacacactatgaggtacattagcaagactggcagaggtgttcactgagggtttagagaattagcctgtataataagggaataagaggtagtggaattttagctaggcatatggatattcagttttagcctccacttcccagcctactttgcaaccagttatggtcatgtgattagttctcatcaatggaaatggaagagcttgatctaatttcagccagttaaaatagcaccatagggattgaagaagcaacaagatggaagaaacaatgtcctcaaatgactaactgaagataggagagctgccccaccaacctggactactcactactagactgttacttgacagagaaataaatcggtatattatttaagtcccg

SEQ ID NO: 466205 - DNA, 1268 bp, Homo sapiens
cttctggcagcttaggtctcacttaatggctgagggctccaggactcaggcccctgggaaagggcccccactcagcatccagttcctgcgagcccagtatgaaggcttgaagaggcagcagaggacccaggcccacctcctggtgcttccaaaaggaggaaacacacctgctcctgcagaatcgatggtcaatgctgtttggattaacaaggagagaagaagctcactgtccctggaagaggcagattctgaggtggaggggaggctggaggaggctgcccagggctgccttcaggcccccaagtctccatggcacacgcacctggagatgcattgtttggtccaaacctccccccaggacaccagtcatcaagtacatcataggggcaagcttgtgggatctgatcaaaggctccctcctgaaggagacacacacttgtttgaaaccaatcagatgactcagcaaggaaccggaatcccagaggctgcccagcttccatgccaggtgggcaatacccaaacaaaggcagtggaatctggcttaaaattcagcactcaatgtcctctttccataaagaacccacacaggtctggcaaaccagcttactatccatttccccagaggaaaacacccaggatctcccaagctgcccggaacctgggcttatatggctcagcgtgaagctttctattctgccagatgtcttgaccttgaggccacctatggccttatagaagaaccaaggaggcagagccacaacgaggtctctagctatgagcaagaactggactaacctaattataggaattgtgggagacgaacttcacaatggtaacatggttttacccttccaataagaagagacttcccaggccaaattgcccacagtttaggatgaagaggactgtctggtcagtgcagccccattctgacattactatgaggtcctggatatccattccttggggaggaccagtaagacatctgctccatccctggaactggataattttggaacataaaccagggacctagccaacagaatgccttagcaatgcccaggggtcaatgggcgtggcattcttgttttcaatgtcttctgatgatttctcatatattctggagaagacaagctctgagaattcagatgctttttctggtggctatgtctggggggccatctcacttagaagtcacaacactcattggcagtgatcacatcatttcaatttgggcttcccaaagtatggtcacccagggtatgaag

SEQ ID NO: 466206 - DNA, 1832 bp, Homo sapiens
cgctggcgccggcgcccgcgcaccgcgccccgtagcccttgcgctccctcgcgcgtcggaggctctagtgaggctcagagtctaggtgcggtccgccaccgccggccccgctccgcccggccccaccaccgccggtccctcggccccctcggcgaccacctcctcccgcacgcaccgtccgcctttgcgcctctccgagctgagccgcgcgtcccgagcccagcctctccggggaggagggacccgtcggcgcggcgtgggtcgggagcgggcgcctgggactacttctcgtttgaaagttttcagaggccaaaagtttgagccggggctgcggaaggatccggctctggcggttgccgcgctcggcgacaactggcgactgaaatttgcatgtgaataagcggaggagcccggggcggaatggggagggcgaggccgcggacagccgtgtgcaccggccccgtggccgcggctttaggcgtccagaggatcgatcgccgccagacatccctggccgtgattgcccgagcacttgaccgcgagggatgggggcgccgcggcctctgggcaggggactccgggcgccccgagggagcagccgggaccagtgcctcgcggacggattgtgccccgctcccccaagggggacccgcgtcgacacgctcctcggtcaccgtcctcctcctgcccgggcgccgcctgcctaaggtggccccagaaagcacaaacgggtcgggcggatctgccgctggcgccggcgcagcccttcccacgtgctccttccggctgatttatttctccaccacgatgccaggcacgggcaccctgtgccaagcctgaggccccctgcgggtgctgaggggagagtggcttaggcgttgcaccccaggagactgaactgggtcagttcccccttgtttgctgccagagaaatgggggtaccattgtcagggagggaagctgaggctcagagacatcatgaggatgccagctcaaggcccagccaggccttggtcctcagctgctgtcatccagtaggctcaagcccagaggcctccagggtgtccagcctccagggtgcctcctacgcagcctccacgtccccatccactgcagcccctgaccatcgggcacaccgtggggccttcgctggccgccgggcctcaggttctgctgcaccaagtgatttttaaagccccatctgcctttctccacttataaagaacttgggacatttcctcgaggttgggcatttttccagatgtggtttcagtgtctcgcttgctacctggtcccctgtgctgggcggtccgctgtgacgcacctggcagtccttgctctaggatggattcgggccggcccttgttctgagaacagagaacggcccttgttctgaggaggctggggtctggaatctgcttcctggtcccctgctgtgtgcagacagccaccgtcacccaggcccaggggtgcctgcaggagtgggctccaggtctgtcactcgtcactcatggggggctgtgggttgactcgtattcccccaaaagactcgctgtatacccccagagcttgtgagcaggacctgttttggagatgggtctttgcagatgtcgtcgagttaagacaaggccatgctggagtggggcctgccctaatccaacgactggggcccttggcaggagagggagagccttgggagggggcccggtcctgtgacacccagattttggatttctggccttcggaactgagagagcacacatttctgcggtttgaagccaccaaatttttggtaatttgttctggccaggaaattaataccagggataaag

SEQ ID NO: 466207 - DNA, 907 bp, Homo sapiens
ggaagggggtaggcccctggcaagtaggagggaagctgaggctcagagacatcatgaggatgccagctcaaggcccagccaggccttggtcctcagctgctgtcatccagtaggctcaagcccagaggcctccagggtgtccagcctccagggtgcctcctacgcagcctccacgtccccatccactgcagcccctgaccatcgggcacaccgtggggccttcgctggccgccgggcctcaggttctgctgcaccaagtgatttttaaagccccatctgcctttctccacttataaagaacttgggacatttcctcgaggttgggcatttttccagatgtggtttcagtgtctcgcttgctacctggtcccctgtgctgggcggtccgctgtgacgcacctggcagtccttgctctaggatggattcgggccggcccttgttctgagaacagagaacggcccttgttctgaggaggctggggtctggaatctgcttcctggtcccctgctgtgtgcagacagccaccgtcacccaggcccaggggtgcctgcaggagtgggctccaggtctgtcactcgtcactcatggggggctgtgggttgactcgtattcccccaaaagactcgctgtatacccccagagcttgtgagcaggacctgttttggagatgggtctttgcagatgtcgtcgagttaagacaaggccatgctggagtggggcctgccctaatccaacgactggggcccttggcaggagagggagagccttgggagggggcccggtcctgtgacacccagattttggatttctggccttcggaactgagagagcacacatttctgcggtttgaagccaccaaatttttggtaatttgttctggccaggaaattaataccagggataaag

SEQ ID NO: 466208 - DNA, 942 bp, Homo sapiens
agtgcggggacgtcctgtggcgggtaccctgctgggtcctgggtgggggccaccaccaggcagctgtgggaacattccagaccacctaggagtagggccccttcaccgtttgaagctgactgtaaaaaacatctgacctgtgtgcaaagctcaagcccagaggcctccagggtgtccagcctccagggtgcctcctacgcagcctccacgtccccatccactgcagcccctgaccatcgggcacaccgtggggccttcgctggccgccgggcctcaggttctgctgcaccaagtgatttttaaagccccatctgcctttctccacttataaagaacttgggacatttcctcgaggttgggcatttttccagatgtggtttcagtgtctcgcttgctacctggtcccctgtgctgggcggtccgctgtgacgcacctggcagtccttgctctaggatggattcgggccggcccttgttctgagaacagagaacggcccttgttctgaggaggctggggtctggaatctgcttcctggtcccctgctgtgtgcagacagccaccgtcacccaggcccaggggtgcctgcaggagtgggctccaggtctgtcactcgtcactcatggggggctgtgggttgactcgtattcccccaaaagactcgctgtatacccccagagcttgtgagcaggacctgttttggagatgggtctttgcagatgtcgtcgagttaagacaaggccatgctggagtggggcctgccctaatccaacgactggggcccttggcaggagagggagagccttgggagggggcccggtcctgtgacacccagattttggatttctggccttcggaactgagagagcacacatttctgcggtttgaagccaccaaatttttggtaatttgttctggccaggaaattaataccagggataaag

SEQ ID NO: 466209 - DNA, 1247 bp, Homo sapiens
gagataccatttcatgaggactgtccaggcatacttttgcttgagttccttagaggcctggagcactgactgcaggttgccatccacctgcatcgtggtgaccttgaccgtatggtgagaggccagcagagttgcatggacagcttctgtattgctcatgttcctgcatggcaaacacaggtgaagctcatcatcttccaccagcagctgctgcagaaggataggtcaatgccaccgggagggcagttcagacacagaatgtgcattatctggatggcatcaggtaaatgattcttccctccaatgcttagtcattggagggaagctgtaaggggtgcaacatccaatgaagctctgccagtccttgttctacttgttaattaaacctaattgagagaagctctacatcatgaaacaactggaaaccgatacatgaccacgtgagttaggaccccaggctctgagccgagttggggatggtcggctgctctctcccgccgcacctggaggattactaggatccatctgaaggcagagctcaggtccctggagccacgcctgattcaactgcaaattccctgagctccccgagctgggcgctgttgggaggtggctggtggcgagccaaatgcgtctctgcccagctaggggatgcagtcacggggcgtcagagctgtgagttccccacccagtccggtggggtccacggggaggcgttcacctgctcactccgtaaccaaaaccaccttcctcatcatcagcgtgataagcacgaaaaccgagcacgcaagcaacagagaccacagcagtttcccagtttatttctatccgagactgacccagcggctccacccacggctcagccgtcgccccctagtaccgcaccggagcacccagggatgccagcctcccgggcccagcccagcgccgcccgcgccagtcccgcccggcggccgcagtgagggggcctctgctggccgcgaggcgcaggaactcagcccctacccttctcccactccaactccttccaagacaagagatcagtatttgacaactctaactctgaaaataagaatagtcttattccagggccagacccaaaggctcaatgtgaaagttcctggactcagaggtgtcacgtaaggaaagaaagtgagtggaaacttgggagtgtggctgtcccatgaagagctcaccctctggaaaacagaaaagggtcctaatcttggaggtttgacactcatcat

SEQ ID NO: 466210 - DNA, 918 bp, Homo sapiens
aatcttctcacctcagcacccccctcaaccccgcactgagtagatggaaccacaggcgcgcccgccgccccgccggtcgcaggcgtcacggcagccccagcagcctgggccccgccaccgcctccgcggcagccccggtcggcgcaagtgcggcgcgcgctgggggagggggcgcggcggagcgctaggctggcgtcgggccaccgcgggattaagtttctcagtcacgcgtgagtgtctgtgcgttttgatccgaagctcctcgccgggtcgttacttcagaagagaagacagtgagcgtgggcgaggcgaggcatccagaggccccggcgacccctgctccccagtcctccgccccctcgcgtcgcggccctgggcgggcgccgcgagccgggggtggcggcgggccgtggggcggtggggcggtgcgcttgccccaccccgcgcggcccggcgcttcgcggaagccgctgctgtggcttttttaaaaggatggggtctagaagtttcctttgctactcgcaagtctccactccccccagccccgcggtggataatcctagacctttcagcacccccgccacccctttcttttgctctcgctgactaagaggttgagttgcaggttggctacattttgtatatttggaaacgtacaaagtactctgaatttcatgaaatattttgaggcaaagttggactggaatgtccccaaatatggtagagcaaatagcacatctgccagagaaagatcctacactttaaagagaagaagcagacaacttcctggtgaatttaggactgcttgatggtgttgcaattttatttgttgagttaatgaaaccattagagccattcttcccaatctggccagctaagttaaaaataaataaataaataaaaggagacaaactctta

SEQ ID NO: 466211 - DNA, 1613 bp, Homo sapiens
gtttatgctcaatttcaataatatggtgcaaagatggaccagcctcacgcaaagggccatacaggaattcatttattcatccatgcacaaagtcatttattcatgcatctatgaagcattgattcactctttcattcatgaattcttaaatgtattcattaatctgttcagcaaattgccatttaaagcttaccatgcaaaaactgccaaattaagctgtgtgtggaatgaagatgattccccatcttcacaaaatgcatctttaagaggggagggaaaagaccttaggataaaaatagtaaatattaggtcattacaaaatatgtgttacaagtcaagtgtaaaagtccaaaaacaagatttacttttgtttggggcagaggtgtgggggataggaagtatattggtcaggagaaggaggtctttaagctgaagcatgacaagtagggggaatttgaagagaatcacccaagggaactagaagaatctgtgcaatgagctgagaaaacacagtagctatggaggaaaaggtgctgaggagtagctgggggctcttttttgctggagtgcagggattggagagtcctaggatgctaacagaagcttgaaagacaaggaagagttagatcatgaagggccgcaaataccaagctaaggagctaggactttgatcctgcacatggtagtgagctggtgaagggttttggaggaatttatactatcagaaatcggtttaatgaggtttaatttggtggttcagtttgcacagaaaattcaatgacgtatttggttgtttgctttcccctcctaaatgcatttaacatccctgtaacactgtgcctagcacataacagggatttttttttatgccttggggttctgtttctgattttctttctgtgtgtttctccattatgttgttgcatttttctctatttacgttatctccctttccctttttctctctgtccctccctccttcttcctctctattcttcccctccccttgtttttatgcctgattatgtggacacagacaaggattaaaacagggcacctgcccttgaggagtttacaatctgctgggctgaggatcaacacatgttcaaaaagagaggaaagaagtcaagggagatcatgccagatggacttaatttcaatgaagaacaggcatttccatggaaagagacaagttgctgcgtgaaaaaagaaggagttgggggaatttgaaaggaagctgaaaagctggcgacagggcttccattacgtagacagtcatcctgacatggtacctgaacaaatcccatcaaggacagattctcagtcttgaagaggcagcacagtaaaggggaaagatcatgagttttggggccaggttcccttggatattgtggggtccccacacttctggatgatgttggataactctttgagacttaggcttcacatctgtaaaatggaaatacttatttttcagagttgtcataaacactaaatgatttgacttatatcaacctaattcctactggctcattgaactcagctcagctgtcccctctgttcggatgccttccccagtggggcttagttaggtatccctgctggataccctg

SEQ ID NO: 466212 - DNA, 1292 bp, Homo sapiens
ggcatatgaatattttaaaatgtacagaaccactctagagttaatgtggtttataaaaatgactttctgtgaagaaggggggctgcagggaggaacaaagcaatcaccaaagcgcacacttgctcatgagaaaaagcacactttgaaaaatgaagtgttccctgtcattagctttcagtcaagcttcccatcaggaaacttttgcatcagatgtgactggaccttgaggggggacgcctgctatgcaggtcctggccctcctgtgagctggaacagatggttccttcacacacatctaaataaagctgtaatggtgctggcccacaaacacggcacaggtgaacctttctatacaaaaaggaaagtgtttcttggatgttgtgtaaaaatcaatttctacagtgccactggttttcattttagacacagtttgtcttcttttttggatatctcatcaatagactgctgttcttcgtagtctaggctagtaccattatgtctttagaatacctccccgccaccccctagagagactttggcatgtttatttctaatacttgaagaaaaggaattttttatttcagatgcatattctcctttactgtcaacacacttaaaagaacatattcaatacatcaaagtactcaaatcaacactgtcaggtggattgcctacgggcaaaaagccctggttacatggggttttagcaagacctgtatttgacacaacttgccttgggcaataagtttggcaatgaccaatgcaagcaatgcaagaaaaaaataaaaataaaaactatgtcacataagtaagactgtaaaggaatgggaagaatgggaagaacttaccctatttagcagaaaatgggattgtgacacaaatgcagtaggtggtggacccaaagcacttctgaagcacaatctggatatcattcttgttgaaccacgaggacctcctgcagacatatacaactaaagaggatagtatgctatcaacagacaaatgatgaagaaaaatagcctcttgaaaatgaaaaccaatgcaaagttctaaagtctctggcagcagacactgaaaatcctctcctgagaagacattacctgcatggttctcaagtggaggtgaaactttacaaaacgataagaaaagtagaagacactttattgataaaatatccacattcgaaaatagttgtgctttcaaatcctggatctgccatttactatctgtgagactgagactgtgtgcaaatggtttagccattttgaacctgtttcctcatctgtaaaatg

SEQ ID NO: 466213 - DNA, 1791 bp, Homo sapiens
tccttccaaggcgtcctggcccttcaccgccgaccgaagcggaagctgaagccgcctttcttcctgctgtagccattgagctcctcagccaggttccctaacgggccgctggtcttctcccccgcagcagggaggaagccggtggcctcactgccttcgtcctgcctcccgaagcggaatctgcagccagcatgctctctgcccgatgtctgcagccccctggctatgacaagcagggcctgtggctgtgaagctctcagccaccgagaggaaccccacacggagtggggtcggggccccatggccaggtcggcccagcgttctccagctccgaggccacccatggcgtctgtgggctctcttctgtccagtagagggaagcaggcgcccagcggcaggaagaggaagtagatcagggggggttcatgcaccccttcaagaatctggtagaaagtggggatgctcatcacgggacaggcggccccagcgcgagtcagggcttcaggccccacagccaggaagggacaggaaaagcacgggcacccctgtgacccacatgcacccctgtgccccgcaggcacccctgtgccccgcacgcacccctgtgccctgcatgcacccctgtgccccgcacacacccctgtgccctgcacgcgcccctgtgcccctcaggccaagccccactttgctgtgtttgacatgttgagctcccagaaaaggttctgctttgaaaccaccagggcccggaggaggcgaggcgtgagggtggtggggctggtggtgcaggaagccgctctgggggtggagtccgtggaccacctcgaagcctgtggggttccctgggaagctgtcctgacataggtccaggccaggagtcccatccccaggcgtctccacctctgcccctcccacctctgcccttcccacctctgcccccaacctgtgccccctccctcttctacccacccacctttgtccccccacctctggccctccctggtctggccccacgtatgtccccccacctctgcccttccctcctctgccccccaaacctctgccccttcctcctctgctcctccctcctctgcccccacctctacccccaactctggcctcccacctctgcctccccacctctgcccctccctcctctgcccccacctctacccgcaactctggcctcccacctctgcctccccacctctgcccctccctcctctgcccccacctctaccccccacctctgcccctccctcctctgcccccctacctctgccctccctcctctggcacccccacctctgccccctcaagctgtcagagcagtgggcattgtgctggctgagtgaaagtccatggtggagggaagagtgggattcgtcttctgtgaacccggacttgaaaacctccggccgcacgggggggtgtgagactccccggctgcccgcccccgacaggtgccagacagaggccgagcacagggcaaggccactgccgctctttctactggccccgtgcggcacctcccacacaggcactcgataaatactggattttattaaataaactccagggattgttttatccgtaagcctcaaattgatgttatgaataaatagccatgggggactgttcattcaataacgtgtctcagttccttggaactctgtccccagccacagggacccacaggatagtttatcaccccggggacccgggagggatgcaccgatgccgcaggacccgggttcatcctccagagcccagaccccaggaggaccgacccca

SEQ ID NO: 466214 - DNA, 1807 bp, Homo sapiens
ttcccatcagcccctgccctgggctccatggaccctggcaaccctggttcgagccccaggtgcgcttcgcgcccgctagggttacccagaagccggcagaaagcccatgagaggaaggtaagacacctggggcaaaggaaaaaaaaaccgcgcttgcagaaaagcggggcctggctcctccacggacgaaggtgccttcccatcagcccctgcgctgggccctggggaacctggtgtccctggctggaaaccagggtgcaccttggacccgctaggggtaccccaaggagagcagaaagcccatgaggggaaggtgaggcacctgcggcagagaaagaagaaaaaccgcgcagcggagaagcggggcctgggtcccccactgacgaaagtgtctttccgtcagcccttgagctgggtcccgaggacgctgacatccctggttcgagcccacgctgcgcctcaggctgctacgagtaccccaaggaggaaagaaggcccaaaagtttcagctgaggtttgaggcaggagagatgaggcacctgtggcagaaaaaaaaaaaaaaacaaaaaaaaacaaaaaaacctcgcagcggagaactggtgcctgggtctcccagggacgaaagtgccttcccatcagccactgcgcttggccccatggaacctggcctccatggttcgagcccagggtgcgcctcgggccgctaggggtaccccaaagtgtgcagaaggcccatgaggggaagctcctgcttcaggtgcagaaacacagctatttccagtgccagctgttgagccagtgccagcaccaggggcagagccccttccagggacagcgctggagctagaggaagctccagagccttcctgccgctgccctgggactgcacaggaccagcccagtgagaagctgcctgacttcatggcacctcctgtagagccaccggcctcagccctggagctgaaagtgtggctggagctagaggtggcagagagggggtgaccagcacagctccagccagcagctcccacactgctcccagtcctgggcacagtggaagctatggaggcagagaccagggtgtgcaacctgggctcctctgcctcactggagagggacttctctcattcagcagagcagcagccctgctgctgaaggccctgctgctactgctgctgggggtgtttgcctgcctgcaggaggtgctggagagcaagaaaaggagcctgtgagcaggggttccagcaggtcctccggctcccagaggtgacctcctcctccaggaatggaggtttgccctcagctgggcatctgggccatttgcctctaatgtgctgcccaggatggcctcttcttgacaggtggacagggtctcgcgggagttctctggatttcttgtatcagcatgtggacctctttagcaagattgaggacagtttcctcaattatatcctcaaaaacgttttccaagttgctcactttctcttcttctctgttagaaatgccagtgcagaagtgacaaagtgccaaaagcgccctgtcccagtgggtactagtcttcagcaggggcagagctgctggagaaacctaagaagcagcctctttcagcccacgttccttgggtcccaacaggatgaccactgctggatctgcagcagtgcactaggaaggggacagagggcaagagatgaccacctctctaaatctgttcctaggctttggtgtgcccctttcagcagctgatatcgtgatcgtgtttcctttgacccaaggggtggctttggcaagctgtattcctccttccctt

SEQ ID NO: 466215 - DNA, 3389 bp, Homo sapiens
  misc_feature (1078)..(1078): n is a, c, g, or t
  misc_feature (1101)..(1101): n is a, c, g, or t
  misc_feature (1107)..(1107): n is a, c, g, or t
  misc_feature (1125)..(1125): n is a, c, g, or t
  misc_feature (1160)..(1160): n is a, c, g, or t
  misc_feature (1163)..(1163): n is a, c, g, or t
  misc_feature (1181)..(1182): n is a, c, g, or t
  misc_feature (1192)..(1192): n is a, c, g, or t
  misc_feature (1203)..(1203): n is a, c, g, or t
  misc_feature (1246)..(1246): n is a, c, g, or t
  misc_feature (1249)..(1250): n is a, c, g, or t
  misc_feature (1272)..(1272): n is a, c, g, or t
  misc_feature (1302)..(1302): n is a, c, g, or t
  misc_feature (1305)..(1305): n is a, c, g, or t
tttgtcatggttgtagatattccatagtcagagcccattattaggctgtgccagctcgggggcggagtctcattattttctgaatcatgagttgatgtaaagggagtggcaactgttttatctacatcaattgatatgctcatatgatttgtcttatctagcctgttgatgtggttggtggcattcattagttttcgaatggtgaattagatttaaattcatgactaaaacaccaaaagcaaaggcaacaaaagcgaaaattgacaaatgagacctaattaaactaaagagcttctgcacagcaaaataaattatcatcagagtgaacaagcaacctacagaatcggagaagttttttggaatctatccatctgaaaaagagctaatatccatattccacaaggaacttaaacaaatttataagaaaaaaatcaaaaagtgggcaaaggatatgaacagacacttctcaaaagaagaaatctatgtgggcaacaaaatatgaaaaaagctcatcatcagtaatcatcaaagaaatgcaagtcaaaaccaaatgagataccatcttacttcagttagaatgactattattaagaagacaaaaatgacagatactgctgagtatgcagagaaaagagaactctcatacactgttggtgggaatataaattctggagcccaatctgctggacagcctgggaccgtccattttcggggtggtgggcaacctggtggccatcgtggtgctgtgcaagtcgcgcaaggagcagaaggagaccaccttctacacagttatgcggctgactgccaccgacctgttgttcactttgctggtgagccaggtgaccatcgccatgtacacgaagggcgggtaacctgggggccagctgctgtgtgagtacagcatcttcagcctgttcttcttcagtcagtccggcctcagcatcgtctgtgccgtgatacctatacaggtaatttgtgttagacattcttagaagagtttcaaaagttttatgtttttatctgggttataaacagagtcctcaaatgcacacaaaggaaatcatgccatgattgaatntcagcaggaataagtttattttncctatncaaaattaaaatactttngttgtgtttgaaaatgtgttttaaagatatgtttntgnaaaaagtttaagtaaatnnttaatcatgnccccttttctntcccaagaaataatttcatatatagtttatttaaattttttancannaatgtagcataatttttttaanttgtatattttatttaacccaatatatatncanaatattgggtcaatatgtaatcaatataaaattattagagatagtttgcgttcttttttcatatgaaatctttgaaatccattgtgtattttaaattttaggatgtctcaactcaaatgtgaaattttcatggagaatatttgaactgtatttagattaatacaaattgcagttaaaaagtttaatatagatttaccagggggtgtgcagcccacttgccaatcagatcgctgctgagcggtcccgcagccaacccccgaagagcagcctgctggcttccccagtgcccaggagttggggatgtcctacaaacctaccacacctgcccccagcagcacccccggctccagcacccctgggccaggcactctggtccctacaggaagcgtcccgtcaccgtcgggctcagggccgggagccactgcccctttcagaccgctgtttaaagactttggaccgcctaccatcggttgtgtgcaggccatgaaaccacctggtgcccagggctcccagagtacctacacggaactgctgttggtcacaggggagatgggcaaagtgatccggcccacctatgctggcagcaagagcgctgcggagcgcctgaagagagaggaagctctaaaagcaactgaagatttacgtgaagaagctgcccaggcgttggcccagagtgacaggaagtgccatgagttcaacaggcaggtcacagttcagtggaaagaaaaggatttccagggcatgttgaagtgccacaaagagggcgaggccctcctcatcctcaacctggtgacagacttgaagccccagatgctgttggacacagtgccctgtatccccgcctacatcctctacatgtgcatccggctcgcggaccaaaccaatgatgatctcaaggtgcactccctgatgacctccaccaccaacggcattaaggaagtcctgaagaagcacagtgatgactttgagatgacgtcattcttgttatccaacacctgccaccttcttcactgtctgaagcggtacagcggggatgagggcttcatgactcagaatactgcaaagcacaacgaacactgccttaagaactttgacctcaccgaataccgtcaggtactgagcgacctttccattcagatctaccagcacctctttaaaattgccgagggtgtgttacagccgatgatagtttctgccatgttggaaaattagagcattcagggtctatctggtgtgaagcccactggctcccagaagcactcctccagcatggcagatgaggataactcataccgcctggaagctatcatccgccagatgaatgcctttcatacagtcatgtgtgaccagggcttggaccctgagatcatcctgtaggtattcaaacagctcttctacatgatcaacgcagtgactcttaatgacctgctcctgcggaaggacgtctgctcttggagcacaggcatgcaactcaggtacaatataagtcagcttgaggagtggctttggggaagaaaccttcaccagagtggagtagttcagaccatggaacctctgatccaagcagcccagctcctgcaattaaagaagaaaacccaggaggatgcagaggccatctgctccctgtgtgcctctctcagcacccagcagattgtcaaaattttaaacctttagcctcccctgaatgaatttgaagaacaggtaacagtggcctttatacaaatgatccaggcacaactacaagagcagaatggccctcagcaactgctattagatgccaagcaaatgtttcctgttttgtttccatttcatccatcttccctaaccatggagtcaatcccagcatgtctcaatctggagttcctcaatgaagtagacgcatgtttagtctgattcccaatgtgaacaaaaaggaagtatagacagtaaagtaaattcaaggatctgttaaatctggtaaaagtagatcaaatcagagattgacagcctgtggagggtgcctgaactatacagaattaacacaactatggcgttattttttgtacatactgctcagaataaaaacacttgaaatgtgaaaaatt

SEQ ID NO: 466216 - DNA, 2801 bp, Homo sapiens
cgtgcgctcgaggcctgagggacccgctgttggtgccacctgccctgctctgcgcctctccgcgcctgcgccggcgccctgcgccccctccgcgcctgcgccggcggtctgcgcctctctgcctttgcgaagggcgctctgcctttgcgaagggcgctctccctttgcgagggcagaggtgccttctcgtcagcacagaccgggagagcatcgcgagggcggagctgagttctcctctgcacagacttcggagatacagcgaaggcggagcagtgttctcctcagcacagacccgggcgggcgcgccgggggcaccgcgagggcggagctgcgttctgctcagcacacacccgggggacaccgcgaaggcagagcagcgttctcagcacagaccttgggggcactgcctcgctttgggactactcgggaccgcatagacgactcagcttcacactccagggctgtgtaccaccagccactgtcatgttaaccccttcccaggccagtgtgtccttggcctggagcccaatctgctggacagcctgggaccgtccattttcggggtggtgggcaacctggtggccatcgtggtgctgtgcaagtcgcgcaaggagcagaaggagaccaccttctacacagttatgcggctgactgccaccgacctgttgttcactttgctggtgagccaggtgaccatcgccatgtacacgaagggcgggtaacctgggggccagctgctgtgtgagtacagcatcttcagcctgttcttcttcagtcagtccggcctcagcatcgtctgtgccgtgatacctatacaggatgtctcaactcaaatgtgaaattttcatggagaatatttgaactgtatttagattaatacaaattgcagttaaaaagtttaatatagatttaccagggggtgtgcagcccacttgccaatcagatcgctgctgagcggtcccgcagccaacccccgaagagcagcctgctggcttccccagtgcccaggagttggggatgtcctacaaacctaccacacctgcccccagcagcacccccggctccagcacccctgggccaggcactctggtccctacaggaagcgtcccgtcaccgtcgggctcagggccgggagccactgcccctttcagaccgctgtttaaagactttggaccgcctaccatcggttgtgtgcaggccatgaaaccacctggtgcccagggctcccagagtacctacacggaactgctgttggtcacaggggagatgggcaaagtgatccggcccacctatgctggcagcaagagcgctgcggagcgcctgaagagagaggaagctctaaaagcaactgaagatttacgtgaagaagctgcccaggcgttggcccagagtgacaggaagtgccatgagttcaacaggcaggtcacagttcagtggaaagaaaaggatttccagggcatgttgaagtgccacaaagagggcgaggccctcctcatcctcaacctggtgacagacttgaagccccagatgctgttggacacagtgccctgtatccccgcctacatcctctacatgtgcatccggctcgcggaccaaaccaatgatgatctcaaggtgcactccctgatgacctccaccaccaacggcattaaggaagtcctgaagaagcacagtgatgactttgagatgacgtcattcttgttatccaacacctgccaccttcttcactgtctgaagcggtacagcggggatgagggcttcatgactcagaatactgcaaagcacaacgaacactgccttaagaactttgacctcaccgaataccgtcaggtactgagcgacctttccattcagatctaccagcacctctttaaaattgccgagggtgtgttacagccgatgatagtttctgccatgttggaaaattagagcattcagggtctatctggtgtgaagcccactggctcccagaagcactcctccagcatggcagatgaggataactcataccgcctggaagctatcatccgccagatgaatgcctttcatacagtcatgtgtgaccagggcttggaccctgagatcatcctgtaggtattcaaacagctcttctacatgatcaacgcagtgactcttaatgacctgctcctgcggaaggacgtctgctcttggagcacaggcatgcaactcaggtacaatataagtcagcttgaggagtggctttggggaagaaaccttcaccagagtggagtagttcagaccatggaacctctgatccaagcagcccagctcctgcaattaaagaagaaaacccaggaggatgcagaggccatctgctccctgtgtgcctctctcagcacccagcagattgtcaaaattttaaacctttagcctcccctgaatgaatttgaagaacaggtaacagtggcctttatacaaatgatccaggcacaactacaagagcagaatggccctcagcaactgctattagatgccaagcaaatgtttcctgttttgtttccatttcatccatcttccctaaccatggagtcaatcccagcatgtctcaatctggagttcctcaatgaagtagacgcatgtttagtctgattcccaatgtgaacaaaaaggaagtatagacagtaaagtaaattcaaggatctgttaaatctggtaaaagtagatcaaatcagagattgacagcctgtggagggtgcctgaactatacagaattaacacaactatggcgttattttttgtacatactgctcagaataaaaacacttgaaatgtgaaaaatt

SEQ ID NO: 466217 - DNA, 7036 bp, Homo sapiens
gtatctccctgcttcctgtttgtatcagagtgaaatgacggagccagatcccccaccagggggactgagaagacaacagaagaattgtctatttcacagcaatattaccagtgacttgaaagcatttacagacaagtttggttttgatgtcctcatcctgttctccagctatctgtcagaggagcagcagccgagacgacagattgctgtgtactcagaaaacatggagctgtgcagtcagatttgctgtgagctggaagagtgtcagaacccttgcctagaactggagccctttgactgtggctgtgatgagatcctggtgtaccaacaagaggacccttcagtgacttgtgatcaggtggttctcgttgtcaaggaagtcatcaacaggaggtgtccagagatggtctccaatagccggacatcctcaacagaagccgtggcaggcagtgcccccctctcccaggggtcttctgggattatggaattgtatggttctgacatagagccacaacccagctctgtgaatttcatagagaaccctccagatctcaatgattctaaccaggctcaggtggatgccaatgtagaccttgttagcccagacagcggactggctaccattaggagcagccgctcatccaaggagagctctgttttcctcagtgacgacagccccgtgggagaaggtgctgggcctcaccacacccttctcccagggcttgactcctacagccccatccctgaaggggcggtggcggaggaacatgcatggtctggagaacacggtgagcacttcgacctcttcaattttgacccagcacccatggcttctgggcagtcccagcaatcttctcattctgcagactactccccagcagatgacttcttccccaacagtgacctgtcagaaggacagctccccgctgggcctgaaggacttgatggcatgggaaccaacatgtctaattattcatccagttcacttttgtcaggggctggcaaagatagccttgtggaacatgatgaggagtttgtccagagacaagacagtcccagagataactctgaaagaaatttgagcctgacagattttgtgggagatgaatccccttccccagaaaggctaaaaaatactggaaagaggatcccaccaacacccatgaatagtttagtagaaagctcgccatccactgaagaaccagcctcactctatacagaagatatgacccaaaaagcaactgacacaggtcacatggggccacctcagacccatgcacggtgcagcagctggtggggtggtttggaaattgactccaaaaatattgcagatgcgtggagttccagtgaacaggaatctgttttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtaagaaacattccattcttccacttccaagaaactgctgcgttgattaaactagtgcatatttgtaagacacactcttcctaccaatgagggtagagagaaaactaactacattttcaaggcatgcctcactaagtcctgtattataacagcagtaaaatctagtgcatatgtaatacctattcctgatagtgcac

SEQ ID NO: 466218 - DNA, 1063 bp, Homo sapiens
ttatcaaagctgatttcagggagcaaagttcccaccaggagaggccacagcctcattagagagttctgggaatgatgaaaagccaggccgccgtgcacatccctgggacaattaggccttgtccctctgccttcaaaggcaatctcactgtctctgcgcgtgtgtgcgcacgtgagaggagaaaccggagatcacgaggctgcctgccggcactgctacgttctctacaaacagcaaactcgaaaatgccgtatttccctgataaataattcccattctaagggattccaccccccattccaagtcccctccaaaaatatatattgaaagaaaacaaaatcacaaggaaacacattttctactcttgtagcagaaaagggctggtaacggatttttggtgtctgcataagctgagagcaagtggctctaacctgggtttctgctgccagagaaggggcctggaaggttctccctgtgaggagatggggcagccctactgggacactgcaataactctgcttcctctaacctttcggctgggtcccgtgctccagggctttcatcatgtccttcatacctctgaagccactccaggctccctggccctcctgtggcttctgttgggccctgccaggcgggccagccagggcaggggcagagggcgaatgaccctctcccctcccagcccagagaagcggggggtgcgggcagccatgtctggggaaggaggcagatgtcacagctgtgccaggttcctcctactgcagggtgagcctgagcttgtcttctggaaaatgcggactgatgccctttctgcaaggtttgagtcctggattctgagcctgttggattctgctgcagcctgctcctacctaggaaaggagggaagcttccgaggccccagtgagatgtctctgccagccacaggggcacaggagggctaaatccagtggccctctcccttctctccctagcttgggttcctttgtgccaccccgcgagcggggtgtgtgtgccccaagccgacatgggcacctacagatgaggcctggtgggctgaacc

SEQ ID NO: 466219 - DNA, 5023 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctcaaaaaaaaaagaaaaaaagaaaagcaggttcttggaaaaccgttgagctcacattctgagttttatttgaataacgttttctcatccttcaacctgtcttcctacttcctaagtttcagggaaatgaaatgtgatatttatgtaacctggggagaaaccctaagctgtacatatgaaggaatggattcatttctcctcttgcacagcaccccagcaccttgtacaccctattcctccctaactcccaaccgcacactcacctcccaagcatctgcagatctacatacatattatcaaatgtacagagtactgagtgaaatggtcactgtagctatggaaagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcaaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaaggaaaatgaacaggcggaaaagatgaacatcagcctggctttcttcttgtatgaccttctctccctcatggatcggggctttgtgtttaacctcatcagacattattgcagccagtctgggacaagctccttgagttttttgcagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataagaacatccagttcattggcacagtgcagggattcaatgatgctgttcttccattcccccaggcgagctcggctctggactgtaaagacagcctgctgggaggtgttctgagggtgctggtgaattctctgaactgtgatcagagtaccacctacctgactcactgctttgcaacactccgtgctctcatcgccaagaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagaagtttgaaatcaaggtgccagcactgttggtgccttctgagggctgtgaggaaagggtctgttccaggcctctctccctgacctgtggacagccctcttctccctgtgtctcttcacatcatcttccctctgtgttcgtgtccagatttcctcttctctttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagcgtaattggatttccccacaaaagttctgagtgtacttgacatcaagggagcagaaacagagaagagaaatgcctattacattcccaagatcaggaaaaaaaaatgaggaaacgtttgcctttgtaagtgccaatcctttgataaaatg

SEQ ID NO: 466220 - DNA, 6299 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466221 - DNA, 6145 bp, Homo sapiens
gagtattgtcacatatcagcccagaaagtcacaggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466222 - DNA, 5841 bp, Homo sapiens
gagtattgtcacatatcagcccagaaagtcacaggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466223 - DNA, 6245 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466224 - DNA, 1131 bp, Homo sapiens
gagctcggtacccgtgctgccacaaaggatgcccggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466225 - DNA, 727 bp, Homo sapiens
gagacagcttttaccatgagaacggctttgctccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466226 - DNA, 5385 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466227 - DNA, 2938 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaaaaaaaaaaaaaaaaaacaagacaaaaaacaaaaaaaaagaaggggggaggcgccgcagctataaaaaaagtactcccccggagagggggcgcccaaaggtattaaccgcggacaccacgaggtttcctcttggcacaacggagggcccccataaagagagaggaggcgcgacagtataattacgcgcaacaggcacctggcgacgcgagagttatacacaaaggtctgtagtagatggggggaaaacaccgcggcgaacaggccaggagggacaacccccttgggggcacaaagagaagaccccttaaaaaaacgcgaggcggggcgggcaaccacaccgtggtgggccacaaaactctcacgctcatcaagaatcattttaacagatccccatgaggggaacagattatccaactggttccgaaaagaccgtgttcaaaagcgggtgttaaaaacaaagccggcgcacaaatgatccgggccgcctgttgaaaaaatgttcgggccaccagcgggatcagcgcaattttttcgagaacacttttttcgccgcggacgg

SEQ ID NO: 466228 - DNA, 916 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgccgcacctccgttctggcccgcacatccgtactgcccggtaccgagctcga

SEQ ID NO: 466229 - DNA, 513 bp, Homo sapiens
gacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactaggtaagtttatctcaatgtgtccccaaataatttctcagaatgttaaattcataaaagctaccatgaaaggataaataaatgaaaggagttctgaggtcaaaacatttggggaaagaagagtctttctccttctgaggcattctcagtgcacagtaacctgtttatctcgctttgccttgctctttcccaagcacatttttgctcaacgccccctaccttccccatacacttgttaacactttgcagagcactagggctctgtgggacaggctgggaaatgcaggttgacatgccactgttaatacctagaaaat

SEQ ID NO: 466230 - DNA, 299 bp, Homo sapiens
acgtcttccgcctgccagaggtgcaaagggatgtgcccaagtcaggtagagttgccctgagtgtgggactctggtgggcggggcaacaccacctccaccccactgcagtgtaatccaaaataaaacatcctatgctgggtgcaggggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggag

SEQ ID NO: 466231 - DNA, 504 bp, Homo sapiens
ttctgaccgtttcatggatgacataactactattgttaatgtggtcacctcggaaattgcagcccttttagtaaaaccacagaaggtaactgtattttactctttattttctaaattgtttacctggaacatatattactttcataatcagagaaaaataagcatcattttaaaacaataattaaaatataactgtaatgacagttaaacgcagtatgttatactggactggaccctgatgtggggctggaaaattgttataaacaaattacacacatgaggccaggggttcgagacctgcctggccaacatggtgacatggtgagaccctgtctctactaaaaatataaaaattagctgagcatggttgtgcatatctgtaatcccagcaactgggaggcagaagcaagagaactgcttgaacctgggagacagaggttgcagtgagccgagatggtgccacagcactccagcctgggtgacagagtgagactctgtctcaaa

SEQ ID NO: 466232 - DNA, 511 bp, Homo sapiens
cgtttgcagaatagctcatcttctccctccgtgccttttcccccttaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggaggtaatgcacccaagggattggccaccactggatgagtgggctgggtggcctcccaggaggacccacaaacctctttcacagtggattggactgaaaacaaggagggatgcacttgaaatatgattatatggttgtcctttcactctcatagtgccagaaaatcccatttaggcagctacatattttatagcactattgtatattaaatatttaatattttaaagtt

SEQ ID NO: 466233 - DNA, 687 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtaagtctatttcagcattct

SEQ ID NO: 466234 - DNA, 638 bp, Homo sapiens
aaactgttggttcttcttacctaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggatgcttcttgacgtcaagaagccaacttagaaagaagggtctcacgtggctggcctggctcctccgtagacccctgttcttttcaacctctgcccacccgtgcatgtcatcacaaacatttgctcttaagttacaagagaccacatccacccgaggattagggttcacgtagcagctgctaaccctagcaccagcccttgtgggactc

SEQ ID NO: 466235 - DNA, 6939 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctcaaaaaaaaaagaaaaaaagaaaagcaggttcttggaaaaccgttgagctcacattctgagttttatttgaataacgttttctcatccttcaacctgtcttcctacttcctaagtttcagggaaatgaaatgtgatatttatgtaacctggggagaaaccctaagctgtacatatgaaggaatggattcatttctcctcttgcacagcaccccagcaccttgtacaccctattcctccctaactcccaaccgcacactcacctcccaagcatctgcagatctacatacatattatcaaatgtacagagtactgagtgaaatggtcactgtagctatggaaagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466236 - DNA, 4878 bp, Homo sapiens
tcaggttgcgaccacgcgtcgaacgaaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 466237 - DNA, 6284 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggaatttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagttgaatatattttgtagctgatatacatatgctggtcgagcggccgcgaatttagtagtagtagcggccgc

SEQ ID NO: 466238 - DNA, 1012 bp, Homo sapiens
tgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgcccataggaccaccccactctaaaggcatacaaagtaaagagatggctcaacacgtgcgccatgtttgctgagtgtcttccatgcacaaactgtacacactgtgttatacacacacagtgttacacacttactcaagcctcggacca

SEQ ID NO: 466239 - DNA, 873 bp, Homo sapiens
tgagataaattcatctttattctatgtatttaaaccaaatccatctcctgctgaaagaactggctacaatttaccttcatcagaggtgtcctgttttcaccatcaaggacgtcaacctggcggcgcccccatccaaggcctggggggcctgcccgggaagaagatcaagacctcggggcccaggacagccgccccgctgcccgccactcctccacctgctcccctcgtccccaggacccccagcccccactctgaaggggcgatcctcccacagccgcctcctcctcctgcagccccggctcaggcacggtctggtacctcttcttcgcatctcttatgttcaggtccattgtcgtcttcttcatcatcctctccagcttccaggcttggccacgggaggcagctttgtggatcttcctgagatccccatggtgaatcacctctgatcctcaattttatatactacacctggtggtggctcagtgttcacttccgaaaaatgaaaaattgcccatttttgtgaaaaagttctactgatatgtgaaggctgagttctattggaaccaccaagtcatgacaccagaagggaaaagaagtagttcatcatgaggtggaaatatctctctctgtggtccaagctggagtgcagtggcgggatctcggctcacttcaacctctacctcccgagttcaagcaaatctcctgcctcagcctcatgagtagctgggattacaggcatccaccaccagagacggctaattttttctttgtatacttttatttaattcggcttaggttacttgtttattagtagtagttttgcatctatgggattgttgtataaaataaatggtttaaatatgtagaatactt

SEQ ID NO: 466240 - DNA, 832 bp, Homo sapiens
tgagataaattcatctttattctatgtatttaaaccaaatccatctcctgctgaaagaactggctacaatttaccttcatcagaggtgtcctgttttcaccatcaaggacgtcaacctggcggcgcccccatccaaggcctggggggcctgcccgggaagaagatcaagacctcggggcccaggacagccgccccgctgcccgccactcctccacctgctcccctcgtccccaggacccccagcccccactctgaaggggcgatcctcccacagccgcctcctcctcctgcagccccggctcaggcacggtctggtacctcttcttcgcatctcttatgttcaggtccattgtcgtcttcttcatcatcctctccagcttccaggcttggccacgggaggcagctttgtggatcttcctgagatccccatggtgaatcacctctgatcctcaattttatatactacacctggtggtggctcagtgttcacttccgaaaaatgaaaaattgcccatttttgtgaaaaagttctactgatatgtgaagtctctctctgtggtccaagctggagtgcagtggcgggatctcggctcacttcaacctctacctcccgagttcaagcaaatctcctgcctcagcctcatgagtagctgggattacaggcatccaccaccagagacggctaattttttctttgtatacttttatttaattcggcttaggttacttgtttattagtagtagttttgcatctatgggattgttgtataaaataaatggcgatgcggccaggtttctttcctccctctccccttgacgacgctattaagag

SEQ ID NO: 466241 - DNA, 267 bp, Homo sapiens
gtggtggctcagtgttcacttccgaaaaatgaaaaattgcccatttttgtgaaaaagttctactgatatgtgaaggtaccacattattcattgaattctcttcctgagtgaatgacatagaaccccgacagataaattaatatgttaaaattaaaagattatctaataaacaacttttccgttttaataaaattgtattttgatatatttgaaagatttttattgtagtgaaaaatatatataaaataaaaaataatgatgttggat

SEQ ID NO: 466242 - DNA, 1192 bp, Homo sapiens
  misc_feature (6)..(6): n is a, c, g, or t
  misc_feature (1183)..(1184): n is a, c, g, or t
  misc_feature (1186)..(1188): n is a, c, g, or t
  misc_feature (1190)..(1190): n is a, c, g, or t
  misc_feature (1192)..(1192): n is a, c, g, or t
agcggntgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgacaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaaaaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaaggctatactctttgctgttgtaagaaaaccagatcctttctctgtacaccaaaatgactggttagaaattaacaaacatcagattgaaaaagtcctgcagcagggagagattggagactgtgcagagccctacacggttatcaaagaaagtgatggtggaaagcaaggtctgactgcataacttgattggggcaaggccaccccctgttgtcttcattctgaggctctgactcagctggttgggaggtnngnnnanan

SEQ ID NO: 466243 - DNA, 1106 bp, Homo sapiens
  misc_feature (6)..(6): n is a, c, g, or t
  misc_feature (1097)..(1098): n is a, c, g, or t
  misc_feature (1100)..(1102): n is a, c, g, or t
  misc_feature (1104)..(1104): n is a, c, g, or t
  misc_feature (1106)..(1106): n is a, c, g, or t
agcggntgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgacaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggttcgagattgaaattgagcccctgtttgccagcattgccctctacgatgttaaaaaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaaggctatactctttgctgttgtaagaaaaccagatcctttctctgtacaccaaaatgactggttagaaattaacaaacatcagattgaaaaagtcctgcagcagggagagattggagactgtgcagagccctacacggttatcaaagaaagtgatggtggaaagcaaggtctgactgcataacttgattggggcaaggccaccccctgttgtcttcattctgaggctctgactcagctggttgggaggtnngnnnanan

SEQ ID NO: 466244 - DNA, 810 bp, Homo sapiens
  misc_feature (6)..(6): n is a, c, g, or t
agcggntgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgacaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgagttctgtgatggagatgccaacatgtaatagagggacccaaagtggatgccagaagagagagaacaattaaaggatgcagagaatatgtccagtgagacgtttgcttgtcagtgtctccctggtggtattagaggggagaatgttccatctgaacagattaaaataatgaaacgtaaaa

SEQ ID NO: 466245 - DNA, 1390 bp, Homo sapiens
  misc_feature (1381)..(1382): n is a, c, g, or t
  misc_feature (1384)..(1386): n is a, c, g, or t
  misc_feature (1388)..(1388): n is a, c, g, or t
  misc_feature (1390)..(1390): n is a, c, g, or t
tttcttttcatggaaagataatggaacatgtcgattggatcatccgtgaaggcctctatctagaaaggagacacttgggcagaattctgaatgaacttgacggacatctgaaggaaaaatattccagtcagaaggaacactgcagtccagtggaaatttcttccagaccagcaccagtcgccccagtgacatttagaaatcactgccctggattgtttcagccaccgaaacactcggtgttcactcctcagttttatgaccctgtggagccagtggactttgaaggacttctgatgacacacctgaacagcctggatgtgcagcttgcccaggagctcggggacttcactgatgacgacttggacgtggtgttcacgacaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaaaaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaaggctatactctttgctgttgtaagaaaaccagatcctttctctgtacaccaaaatgactggttagaaattaacaaacatcagattgaaaaagtcctgcagcagggagagattggagactgtgcagagccctacacggttatcaaagaaagtgatggtggaaagcaaggtctgactgcataacttgattggggcaaggccaccccctgttgtcttcattctgaggctctgactcagctggttgggaggtnngnnnanan

SEQ ID NO: 466246 - DNA, 1152 bp, Homo sapiens
  misc_feature (6)..(6): n is a, c, g, or t
  misc_feature (1143)..(1144): n is a, c, g, or t
  misc_feature (1146)..(1148): n is a, c, g, or t
  misc_feature (1150)..(1150): n is a, c, g, or t
  misc_feature (1152)..(1152): n is a, c, g, or t
agcggntgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgacaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaaaaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaaggctatactctttgctgttgtaagaaaaccagatcctttctctgtacaccaaaatgactggttagaaattaacaaacatcagattgaaaaagtcctgcagcagggagagattggagactgtgcagagccctacacggttatcaaagaaagtgatggtggaaagcaaggtctgactgcataacttgattggggcaaggccaccccctgttgtcttcattctgaggctctgactcagctggttgggaggtnngnnnanan

SEQ ID NO: 466247 - DNA, 1181 bp, Homo sapiens
gtgtcttgcttttggtgcttagggactctcacagccagattggtagcaagggatactgaccaatgatctacttatcaaacaactctccatttcactggacgctttgcgccataaaactttcctttcaacttacagtcaacaacatccttctcatacttctccttcagctttgccgccttagtgacatggtttttgtcccccccgccatcaacgaaagccctaagctgaagagtaggtacattatcactagcaagttatgtgaccttgagcaagtcacttctacaatatcgggttcgatttcctcatttcaaacagaaggagctggcatctgggagatgacagttcctgtagctgctcttcagggctccagtgcaggttctgccaataaacagtgtatctgcaagattaagagagtgagagtagagaggattatggcttctggcagcggaaggcaggtgagcagacttcagcaggctttggaaagaaggtttcagccacatgttccgggtgtcttcctgcaaggtgttcacctcagtgctgcagggagctgagtttgttggtagttcctacacagcttgattttcttaacactaacagcagtcttctgcccttccaacagtttgtttgtttgtttgtttgtttgtttgtttgttttatataaaatgctgggattacaagtgtgagccactgtgcctaatctataaattgctttctgatataagctactttctttttaaaagtgtttttagaaaaaataaaaagcatgtaagaacacagctttaagaccattttaaaagagaatttaatccaatggttgtgagctgaagttggtaaagcccacataatgctgggtcatgcacataccgagatactcaacaaggctttgatgaataggtgaatcaatgaatgaatgaaatgcctgaggccatcctgattccctcaatgaactgaagcagggtgacaagggtgtgggcagagtggggggtcagaagtgtgaggggagggggggatgtggatgagccactcaggagaagtctgtctgatgaataggtttctaaatctgttgctaagaaagcagcagcagacatctgacttttgtggggctgctccctagaacaaactattaattattaggtgctcattgtacatgcttttttactcctttattttccttttttttt

SEQ ID NO: 466248 - DNA, 990 bp, Homo sapiens
ggaactgcaggggctggcagggaggtctgagttacgcggatgggccacgctccgaccgcacccccgagtccgcctgtccgtgtgtctgtgccgcccgcaggacgtgcttccggcgctgctcgcaggactgcggcacgggcggcccctctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattggcggccgccctggcgtgacccccgaggaaggggtcgaggagaagcttggtccacgccacctgctgtggcaagcggagcgtcatcgtctcccgccccgtgcgtcagcgagaccttgggtcaacacgaccctgcgcacagccttgacccccgacagcgaggacctgacctcacagagggaggcgtccagggcggcccttgggtggccagtcccgcaggcagggcccggggaagcccggatcagacctccaggtctgatccgcccctcagtgggagcgggacagggacacagggcacctggacgcgcgggagagggggcagaccccgcgttaggggtggcagcagctgtcgcccggccacacctggtggtgtcattctgaaccctgttgcaatataaagggatttttttttaaccaacttggtttctttgtctaattattttgctttgccgctcccagtctcacgcaggccttccatgtttgtgaaactactacttgttaagtctttgtccagtgtcttacagacttgagg

SEQ ID NO: 466249 - DNA, 2903 bp, Homo sapiens
tgctccggtgttccaggtggagccccaggacatgacagtgagatctggggatgacgtggccctgcggtgccaggccactggagagcccacacccaccattgaatggctacaggcgggtcaacccttgcgggccagccggcggctccggaccctgcccgatgggagcctgtggctggagaacgtggagactggggatgcaggcacctacgactgcgtcgctcacaacctcctgggctctgccacagcccgggcgttcctggtctgtgccagccacgccatcgtgggctcccggcatttcagagacccacaggtcttctgtgagtttgtggtcccgcctcctcattttacaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaggttccggcaggagtcacacgtggagtttgctacaggggagctgctcacgatgacccaggtggcccggggtctggatcccgatggcctcctgctcctcgacgtggtggtcaatggcgttgtccccgagagcctggctgacgcagatcttcaagtgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggaggagaacgaggtcggctgccccgagggctttgagctggactcccagggagcgttttgtgtggacagggacgagtgctcaggaggccctagcccctgctcccatgcctgccttaatgcacccggccgcttctcctgcacctgccccactggcttcgccctggcctgggatgacaggaactgcagagatgtggacgagtgtgcgtgggatgctcacctctgccgagagggacagcgctgtgtgaacctgctcgggtcctaccgctgcctccccgactgtgggcctggcttccgggtggctgatggggccggctgtgaagatgtggacgaatgcctggaggggttggacgactgtcactacaaccagctctgcgagaacaccccaggcggtcaccgctgcagctgccccaggggttaccggatgcagggccccagcctgccctgcctagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcctgtgccccgccggctaccgtctgctccccagcgggaagaactgccaggacatcaacgagtgcgaggaggagagcatcgagtgtggacccggccagatgtgcttcaacacccgtggcagctaccagtgtgtggacacaccctgtcctgccacctaccggcagggccccagccctgggacgtgcttccggcgctgctcgcaggactgcggcacgggcggcccctctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattggcggccgccctggcgtgacccccgaggaaggggtcgaggagaagcttggtccacgccacctgctgtggcaagcggagcgtcatcgtctcccgccccgtgcgtcagcgagaccttgggtcaacacgaccctgcgcacagccttgacccccgacagcgaggacctgacctcacagagggaggcgtccagggcggcccttgggtggccagtcccgcaggcagggcccggggaagcccggatcagacctccaggtctgatccgcccctcagtgggagcgggacagggacacagggcacctggacgcgcgggagagggggcagaccccgcgttaggggtggcagcagctgtcgcccggccacacctggtggtgtcattctgaaccctgttgcaatataaagggatttttttttaaccaacttggtttctttgtctaattattttgctttgccgctcccagtctcacgcaggccttccatgtttgtgaaactactacttgttaagtctttgtccagtgtcttacagacttgagg

SEQ ID NO: 466250 - DNA, 1033 bp, Homo sapiens
gcaggtgtcatgaagatattatcctttaataggagctctggggacagggtggaatgtgcaacccaaaagcctgactttagccccttctctgtgaagagctatcttttttcatacatgccaggcccccagagaaggcgtgacacagagcccagtgtgagcgtcataatttttcacgagaacaggtcatcaggacacatggtggtagctggcttctgcaggcaaggggctgctgccacagcgaggaggggaatggagctggaccctgggccacgccgcacttcccatgacaccaccccacacctgggcagcagggtggaaagactgctgcagggcatctacaccctgccagagcccgcagcctcttacggaaaggggtctccagtcacctctcatgaggagacgcgtcccactgcctcattgaggtggcctcagggtgaagaatcaggacccacctggtgcaacgaataaacccagactctcagcatcgcgaggagaaaaagtcttgcaacaccgtggcgaccaagtaactctgtgcacatactaagctgacggcgatgctgctgtgtgaggatgccctttgagaatccctgctacaaagcccctgccagtggagtggcattgctgtgtggtggccttgcactgcggattgcccaccggagggatgctgtgtgagcactggctgtgtcaccctgccactgtgtctctgcttccctggaaacatgcgtttctccactttcaggcagaagcaccaactgctcctgtgaattaatatgctcatttaatgctcattacatttaaattttgtcattgaaagggctcattttcccatactggaccgtggccctctccctgctcacttctttagaataaagaagagcatgaggctggtgaaggggactgatgcattattgcactggctctgtctgtggtgacaggctcacaaaaatactgtcaccatggtatttctcagcatttgctacataggaggtttttcatacttcaggaaacatatttaccattttaaaaccaaaga

SEQ ID NO: 466251 - DNA, 364 bp, Homo sapiens
gacctctcctcgtctgtgcacagactggtggccgactctggagcccaggctgttgcttcctggtctggtgatgaatcctccatagtctggaaaggggtctccagtcacctctcatgaggagacgcgtcccactgcctcattgaggtggcctcagggtgaagaatcaggacccacctggtgcaacgaataaacccagactctcagcatcgcgaggagaaaaagtcttgcaacaccgtggcgaccaagtaactctgtgcacatactaaggtctcaaaacacaggcacggcccctggagttcccagtacatcaacatcagcctggggatcatgtcctcatcaaaagctggaaagaggagaaactcga

SEQ ID NO: 466252 - DNA, 310 bp, Homo sapiens
  misc_feature (35)..(35): n is a, c, g, or t
gtccggaacctttatggacccatcgctcttcaatncgtctgcgcttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtgg

SEQ ID NO: 466253 - DNA, 1382 bp, Homo sapiens
cgcgctggaagccctggcggcggcggccatggggcccttggcgctgcccgcctggctgcagcccaggtataggaagaatgcgtatcttttcatctattacttaatccagttctgtggccactcttggatatttacaaatatgacagtcagattcttttcatttggaaaaggtaaaactccgaaacagtttttttatttttaacttttaatccttgttttcacctcatcctgcttatattaaatttctacacacctcaaccttctagatacagattcaatggttgacactttttatgctattggacttgtgatgcgactttgccaatccgtatctctcctggaactgctgcacatatatgttggcattgagtcaaaccatcttctcccaaggtttttgcaggagattttcccctctgtcctcttcaattaagggatgacctgacatcatggatagcttacaactctggaaaccaggagacttcggatatatatatgtttccagctcacagaaagaataatcatcctttttgtggtgatcaccagtcaagaggaagtccaagagaaatatgtggtgtgtgttttattcgtcttttggaatctattggatatggttaggtaagaaggcaaaataatctcttaaaacaaggctaaattgctttctgcagtgaaaccagtactagcagtaaccagaggttacttggtacgagagaggaaaacataaccccttttcaaattatttatcttgatatggaaatgtatttttagtgttctccataatgggcatatcaaagataatgaaaacctaccgtggtattacaagagtaaatcagcacattcaggtttctgcagaaggcttggcctaaaaccaacttggaataaccctcagctgtttcctaacaaaggcattcctcacaattgctttagtacggttgctttaataagcaaagcaggtcttttattgtatcaccagaatttacagttagtttctgtgcattcaagaatcttttaaatatagggcctctcaggaagaaaatgcactctcacattcatttacaattccagtgggttcaaatgactaacttaagtccttttagtgctaattctaaaactttgcagtgagatgtgcctagtcttacctctacaagtggtggtgtcaaacagtcccctttgctcagtgagtgcttacgcctcactctggggaggtgtcctaactgctaggtcagctttcctaaataagaaccgtccctcctacttgagagatctggatttgaataggtaacaaaagagccctagtttgtttttcagccaagggtatgtaaattttttcattatattgtcaataacttaactgaattaaaatatgtttaaataataaaaaaaaa

SEQ ID NO: 466254 - DNA, 1280 bp, Homo sapiens
cgcgctggaagccctggcggcggcggccatggggcccttggcgctgcccgcctggctgcagcccaggtataggaagaatgcgtatcttttcatctattacttaatccagttctgtggccactcttggatatttacaaatatgacagtcagattcttttcatttggaaaaggtaaaactccgaaacagtttttttatttttaacttttaatccttgttttcacctcatcctgcttatattaaatttctacacacctcaaccttctagatacagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtaagaaggcaaaataatctcttaaaacaaggctaaattgctttctgcagtgaaaccagtactagcagtaaccagaggttacttggtacgagagaggaaaacataaccccttttcaaattatttatcttgatatggaaatgtatttttagtgttctccataatgggcatatcaaagataatgaaaacctaccgtggtattacaagagtaaatcagcacattcaggtttctgcagaaggcttggcctaaaaccaacttggaataaccctcagctgtttcctaacaaaggcattcctcacaattgctttagtacggttgctttaataagcaaagcaggtcttttattgtatcaccagaatttacagttagtttctgtgcattcaagaatcttttaaatatagggcctctcaggaagaaaatgcactctcacattcatttacaattccagtgggttcaaatgactaacttaagtccttttagtgctaattctaaaactttgcagtgagatgtgcctagtcttacctctacaagtggtggtgtcaaacagtcccctttgctcagtgagtgcttacgcctcactctggggaggtgtcctaactgctaggtcagctttcctaaataagaaccgtccctcctacttgagagatctggatttgaataggtaacaaaagagccctagtttgtttttcagccaagggtatgtaaattttttcattatattgtcaataacttaactgaattaaaatatgtttaaataataaaaaaaaa

SEQ ID NO: 466255 - DNA, 816 bp, Homo sapiens
cgcgctggaagccctggcggcggcggccatggggcccttggcgctgcccgcctggctgcagcccaggtataggaagaatgcgtatcttttcatctattacttaatccagttctgtggccactcttggatatttacaaatatgacagtcagattcttttcatttggaaaaggatacagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtgg

SEQ ID NO: 466256 - DNA, 1238 bp, Homo sapiens
aggcatacgttaccacatccggcttttttttttttttttttgctagcgatgtgcaggtatgatatcctttcatgatgctgggccgcggcatcaggccgcagctcccagtcggccgcatgatcaggaaggaatttttcacatgtacaatgaaaaaggaagtgaataatctccatttgacttcaaagtgctgcataaatttgggttataatccagttttttcttcctatatctgcatttttaacccacgggatacagattcaatggttgacactttttatgctattggacttgtgatgcgactttgccaatccgtatctctcctggaactgctgcacatatatgttggcattgagtcaaaccatcttctcccaaggtttttgcagatattagcagaaaatgatgtttatgagcttctcatctcctttcagctcactcagtgtatccttactggcatatttcccttgatgcaaagaggcaaagttgaagagggaagcagctctgcacagtagacaaaatactggacaaaaagcaacggcatctgaggccttcacttcattaactcactgtatgaaaccatctagttgcaggaaaataagctcagggctcccactgattctgcattatgcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaataccttgtatttgataaaaatccattacatgaaataactgcacatacccccaaaactctagacataacaggctatgtttttcacacattgtatttttaagacatatatattctccataccctgcttcaccaaaattcctgcttcatttggattttatacaagttatacttacattgtatgaagtctgattattttcctgtaagtttaatgagaaataggagattagctgcaatagattcaattaaattaagaaaccaaacttgataacctaaattacatgtattctttttcacttccaagttcccaaatagatctgt

SEQ ID NO: 466257 - DNA, 1138 bp, Homo sapiens
cgcgctggaagccctggcggcggcggccatggggcccttggcgctgcccgcctggctgcagcccaggtataggaagaatgcgtatcttttcatctattacttaatccagttctgtggccactcttggatatttacaaatatgacagtcagattcttttcatttggaaaaggatacagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaataccttgtatttgataaaaatccattacatgaaataactgcacatacccccaaaactctagacataacaggctatgtttttcacacattgtatttttaagacatatatattctccataccctgcttcaccaaaattcctgcttcatttggattttatacaagttatacttacattgtatgaagtctgattattttcctgtaagtttaatgagaaataggagattagctgcaatagattcaattaaattaagaaaccaaacttgataacctaaattacatgtattctttttcacttccaagttcccaaatagatctgt

SEQ ID NO: 466258 - DNA, 1098 bp, Homo sapiens
gtgagctgagattgcaccactgcaccccagcctgggcgacagaacgagactgtctcaaaaaacaaaactaaaaatttagaccccttctgtcttatttgctttaaaaccctcagggaaaagaaaaggtatttttttaaatgctattcaaaaaaggaaactatcaggctacaatcatgaagattataaggggtcagaaatataagtaaataaaaaggaaagaaaaggaaatggctgattgctttgatcacacagggtgagaatttcttgccacttagtgaaatttccctcattgtttaaatgggtttgcaccacagttcaaagctaactactgtgaaagcaactcagtgtaaattcaaaaggacccttttttctctctctctttttttttttttttaaacagattgcttctgacaagcctgcccgctgcgtggcttttccagctacactgactagcattgtgttcacctggagagaggagattctaaaccatccactccctgctgatccttagtttctggctggtgacacaccagaaggataggatggctccaatctccctgatgaaggggtaatcacctgactttctcttggaaacagaggcactggttcaggtccacaacattgaacttggagagcaataacctctgtgtgcacagtcactgctggctgaatcaaaaggcaggcattagggataaacactgtcttttaagaataggagtgaatgtctatacatttctgacaaacgcagttttatttaaacaaaaaaaaaagtggagactgggaagaccagagagggaggggcaaatgaaggggcaaaggaaagaagcccagtttctggaattattcaactaagtatgcttttaaaagctaacaaccacaaaaccctaagccaaaccctgtttactggccccttgctagccttgtgtgtttgcactcttgctccataacggcttgtaaataccaccatgtaaaaccttgaaggcaaacagaagacaagaagggacaagctgcatgtgctaggggtgaatgaagtatgtgtcaaggtatttggatggagatgtgcccagaatcttcctagtcaagcttaataaactttgg

SEQ ID NO: 466259 - DNA, 1432 bp, Homo sapiens
ccaggtgatcaaagttgacatcatgtatctgcatggggaagagcagagcatcacttttgcactgtcctgccaagaaggcatggcctggaccctgcctgaaacacattctacagaatgtcaggcctctctttttaaaaccatcatggccatgaaaaaaaggaaggaaataaaagcaaaagcagacaaacaccccccaacttttaaagcatattatggccaggttaaaatatctccatctcacaacatgagggcaaagaaacaaaataactgtgattttcagcgagcaggaagccaggtctcaggcaaacttccctcagcattaaagggactccacacattagcaggcaaagagcccaggagctgttgcagagaatttatttatacccatttggaatttcctgacgaactaacagcctgctggccacggggtttaattccaggactcttggcgtcataaaggtttgtatggtgaaattccaattccacaacctctgatccagttgggagggaaatcagggatcaggcaaatctggccataaacaagagatggagtctggctatgttccccacaccggtcttgaactcctggcctcaagcaatcctccctcctcggccttccaaagtgttgggattacacgtctgcgccaccccatctggcctaaaatgttttgaattaatgaaaacagtactgtaccaatcaagagaagtaggatggaggatctggtgaaaaagagattgcttctgacaagcctgcccgctgcgtggcttttccagctacactgactagcattgtgttcacctggagagaggagattctaaaccatccactccctgctgatccttagtttctggctggtgacacaccagaaggataggatggctccaatctccctgatgaaggggtaatcacctgactttctcttggaaacagaggcactggttcaggtccacaacattgaacttggagagcaataacctctgtgtgcacagtcactgctggctgaatcaaaaggcaggcattagggataaacactgtcttttaagaataggagtgaatgtctatacatttctgacaaacgcagttttatttaaacaaaaaaaaaagtggagactgggaagaccagagagggaggggcaaatgaaggggcaaaggaaagaagcccagtttctggaattattcaactaagtatgcttttaaaagctaacaaccacaaaaccctaagccaaaccctgtttactggccccttgctagccttgtgtgtttgcactcttgctccataacggcttgtaaataccaccatgtaaaaccttgaaggcaaacagaagacaagaagggacaagctgcatgtgctaggggtgaatgaagtatgtgtcaaggtatttggatggagatgtgcccagaatcttcctagtcaagcttaataaactttgg

SEQ ID NO: 466260 - DNA, 1339 bp, Homo sapiens
tgcacgcgcgatgggcgcacacactcgcatccctacacgtgcacacacccgcgctccaattaccgcgctagcgcgcaaaagagccgcaacttccgagtgggactcggcatgcgggggcagtgcccggtacttcaccatcagtcaccttcgcgtccgcctcctcccctgctggttgcacctccagccgcagagatttccggctggggcaccagaactgtccaggccgaaagagctgctcctccgtcacaaagcgcagttgcacactgtactgcaggcgcgcggggacccgggccggagccgggccctagcagtgcctcccccgcgctgctctgggcaccgagaaactgctggggcaagggggagggatttggaagcgcgcaccaccttccccagctcccgttgcaagttcagtcttcgacctccgagacgcccggtgacttctgctggcacctgctgccctcggcatcacctccctcatccccctggagggcacgctggaaagctgcaactccccaccctccgcacaggagcgccccgtagacgcgcagatgggcccagccacccagcggggcggcagccctgagcacacaagtttggagagcgcgcgaggcacctgaaagtggttggggtttggaagcaaaagggtgacacctgctgttcgctgggaccgctctgcgggtgtgggcgtcggtttggaaacgtcctttgcctgagctctgcttgaacctgggtgccagagactacctgggacagctctactgacatcatcagcacgtgattctagcctcattaactctaacttgggaaaagtgcttctggaggaaagggaagagattctaaggctgtgtgccccattcttattactctatctcagtgggtctcaatcccggctacacattggaatcacttggaaagctttaaaaataaaaccaaacctgtgcttgggctccaccataggtgttcaccacagctgtcagtataaatcaatgcatcttggttccattcttcatcatttgctggtagctaaattatggtaaattcagctaaggacattttaaaatcctgtttaatttgtccacatgctaaatatcccagcacacaagagaaaaagcagcatgtacttggataagacaaacctagggcttccttcgagttaaggaacagtcttggaagtcttgttatagttaatggttttttgagtggatgagcaaatgaatgaatatacaaatggttatgcacacaattaagcaaactacttgatcacattcctccttttggttttgcttcctctacctgtcagttgtcctgaacacctgcggaggtattttgtgcaggatgg

SEQ ID NO: 466261 - DNA, 1792 bp, Homo sapiens
gtgcccacggcagaccttactaatcaatcgttcgtctagcaaacagcttcattgttcaattttgatttcaactgctgctgactggccttcgctaatccttgcgaatgacctggagccattggtatggcttctcgaaggagcaaatcgattctcattttcaaaggcacaaatgcctagctttccttctgctccgcttgtggaccagagccattcaacccagcagaaggctggtgccgcctcgcaaggaggaacggccaatgcctcatctccagatttgtgcaatgctccccattctaacaggaccagctccttcgccaaccgggataaagcctcccgctcgcccggctcccagggctgctggcggctcgccgtgggcttagctaaccactccggggtggtcaaccctggcctggattctcgacaagcaccctgtggctgtcctaggcatgggtcctgctttatcctgaacccactgcagagcctttggctgctcctgcaaatccaaacaggacctgccctgcccaccctctacctggccgccgcatcccctcacaaagttgagctctcttggaccccagggccagcagccacgctacccccctttgccctggaatcccaacccatccttcgagaccccctgtgggccgccaccttgatacgttccccacggaggccgatcgccagagagcattaaaagcccaccgggaagagtgtgccgtgcgccaggggaccctgcggatgggcaactacacccacccctagcccctccctcccctgccacaagaagccatcttgacatagtggaaaattcccagaaggactccctatcttgccccaaccctgacattcccccatttttatgcaggttctgcttcaaggagctcagattcaagtcttaggctaattgtttttgggcaggctcaccctgcctcttctcaagccctcacctgccaagacaagcccaaattacaagacaattttttagactccaggctaagggtcgattccatggctctgcccattaagtgttaagaacgacctgtgtatttgctgcagaaagcatgacagtgacgtgctttgaaagccctcattttctattccaaacatgagttttaattgctctttttgggatgcctgatgtctcatcacggcagtattatctctctgggacctctgacagcaggaagagccaatggttcattactcgagcctgcccccgcctcctcagtgctggggccccgtcaatcaagcaggccaagttggactcctcccccaggactgactttggaaggtcaacccactctggaaaaagccttccaggccagcgggtagactgctgaacacaggctgctgagcttctcagccgaattcctggacacttcctcactcggtctttccgtgtgttctttggattctctctgaaaattttatgctgatctattttaaattaaaaatgctatttgtcatcctccttttgtgtctccatttgaaaaccagtgagcaaatcagccttagagacatcaaatgagggtgctgccacatagagacctctcaagatgccctggaagcatcactctgggtgctctctggagtcctccgggtgctcccagcccaggccggaagcagtgctcactggagagaccctcagctccttgtcctacagtgccacctgctggcgagtctgagtcagaggcggcggagattcccggcccttccctctctcctggcgtccttcccccaccaagcctggttcttcccgcctcattgattatctgtgactgcacaaagcccc

SEQ ID NO: 466262 - DNA, 2801 bp, Homo sapiens
gtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttccttctccctttttgtgtggagccgagggaaagggcaagcacaaaaacagcattgaccttgagtatgtgccccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagttatgggcggagatattttgagagatgtgtttgtctgatgtaggatgccaagaaacaggacccaaggcaaaactgctcaactctgttaacttctgttactataaataaaggcatgtgcctagttttgatacagaatggaatattttttatacttgtaataatatcacactggaccagtttactgtaaacaaagcccttggtttctccagaaggtggtacaccactagatgtacctgtaaaatgcaagtcatgagcatactgcccttgctagatggctgttaatgtttttgtgttgtttgatacagtc

SEQ ID NO: 466263 - DNA, 759 bp, Homo sapiens
cgattgaagctccgcaccgggtcgggtcgggctcccgaacccggagagtccgcagttttgcccattgcggcggcagcgacagctgggatcacccccagacacgagacacctaaggccaggctcatggaaccaacatgcggaaaacgcacagaggcgcatgcttggtgctatttatattctgggtcctgactgagtgtggcagcacaaatcatccatcctgtgctgtaaaccaattccaagttctggaatcctcgggagattttgcctcaactttcctgggaaattggattggaagaactacccttatgttcattggaaataaggtgaagacaaaggtttggcaagatgctgattcagagtgcagcaacactcaggctttcaggccctgccccattccacaagttgtaggcctgcagggctgcgttcagtgggacactggaatgacattaacaggactgatctgggaagttaatcatggcaaggaaggtgccaggcctgaatgcctggaggaagttactccagagggtatcaacttcctgggacttcctggtggaatatactccagtggccagataatgctttcaggcagagaaattcaggaagccactggcttgtccacgcaagcagagaaagcaggtgtcagatgcacgcagacattgaagtttgaagtattccgaacagagatcaaacactgacttcatgtatggcaacaggcacttaaaaaaaaaaaaaaagcacttctgcatatatgatcatctc

SEQ ID NO: 466264 - DNA, 853 bp, Homo sapiens
cagttatcacacagtgcaaatgatggaagatggaagtacacgaagcctaagagatttttttactgtaagtttctcatggaacagcccctggtcatgtcttctggtcacttccattccaggacaggtatccacctctcttccagctttccgattcacccccgttcttgtcccccaaacactgacaatccccatcagccaatcctgcactgtggcccagatggggcaatacgtttcactgggcccattacatttctctcttgctaatgtaccagttctagttcactttattttccagacagcagttcagaagaaagaatggctttggcagctgtatgagcaaagggctttcaggaaggaagaacaaatgcagggagacaagatgaagaaaccaaggcacagactcatgtccaggaccctaaaaccagtgcatggtggagccagcattcaaacccagcacacgggacgccagagtccatgctcctaaccactacattgtgatgccttgaaactcatggcagagaagagtttgagagaaaggtttcagaaagacaaaagtagaaatcctgaaagactctgagcataaagttaatgctgcagcaatagatttagaaaaatgatgcatgatgatctaagtggaaggtgtgacatacccccaaagaaatgctgaattccccaggtagggtggggatccaaacaaagggagacttgtgcctcatttccttagtggaaccgaaggagcaacaagcctccccttgctctctctctatacctccaccagtcacaggcagagaaagtaaaggtggggcctgctgagcacgtcagagcagaatgggcatggcatagctccgtcaag

SEQ ID NO: 466265 - DNA, 1981 bp, Homo sapiens
gggtgaagcggccaggtgaggagatgggatttcaccatgttgcccaggctgatctcgaactcctgagctcaagcaatctacccgcctttgcctcctgaagtgctgagattacaggtgtgagtcaccgcggccagcctgtctctacaatttaaaaaatctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggaggaggactgaatgttgatcgtgcaagccctacctgcgaggcactcagacgcacatcatcttacacaaccctctgagactgagacctgagttatctccagttcacaagagaggaaagcactctggaggtgaggtgaagtggtgtgcccaggccttctagctggccccgattgagtctcactggatagcaatagtagctcctgaatttctttggaaggtggtgttaggggcctggtcttgaagttgcatttgcatagcaagcgcatgggtttggctcatatcatatgtttaactgggggagctgataggaatatatcatataataaaatacatatttggtgtttgcccctgg

SEQ ID NO: 466266 - DNA, 1153 bp, Homo sapiens
ctagtgctcattcttttggctgcatatttaattcacgagtgggtgatcacgtagagatgaatggaacgactgagaggaagcgtctcccttggttattttctgttgccgcaggacctgattcagtgcttggtgaggatgaagcaagaaggcaccatctgtgaaccagaaaataggccctttccaggcactgaatctgacttgatcttagactccccagacacccagtttacgggattttgctatagcagcccaaatggactaagacagggggacaatctgctcacatctcactgggttgcaggtggggatggtgtcgtgtccaggaaagggaaagaccgagttcctgacagcctcctcatgaaggtgctgagccagcgcctggaccagcaggactgcatccagaaaggctgggtgctacacggcgtcccgcgggacctcgaccaggcacacctgctgaaccgcctgggctacaatcccaacagcaccttagctttcagttaaacatttttatgattaactcagaaagtaatcttagccgtaaaccttcaagttcagatacaggctaagaaagagagaaatattctaaaatgaatccacctagcaccaggatgactatcaggactgtaattctggttcggttgtgatgccaattataaaacactctagctgtggtgttgctgtttttgacaccaggaggaaatcttgacagaattatagcctagaaatcaatctgggaatacgatacagaaatctataattcagatatgaaaatctacaaaggctctttttttaaggaaggttcaatgaaattagattaaaataaatttacatatatatcaattttattattaaaatatattcacactagtaaatagagttatcggggaagggtaagctactcagtgtattggacacaaaaatagacctctttggcttatcagaaaacaaagctattgtctccttgtcaaatataaatctcttcttagagctaataaatgggtagtgttcaaatgcaatgttttgtctgactcctacctcataaacccatggcacataatactaaattatattccactgagcagtatcaatctcttgattccaacatcatacagtaagggaaacaaaccaagtaattgatctgtcgaaaagaagg

SEQ ID NO: 466267 - DNA, 1853 bp, Homo sapiens
tctgagactttacttgggaaaggaggaacaaaagtgggtgaggatgaaggtggagctgcttgccactgagaggacagaacctgagaaacaaggtgtgatgaaaaagaagcaactttattcaagtgctactacttgggaaatggcaaggctcatgcttctgaaagacaatttcatatttggagctgatggggctgtcactaccccttctaggtctagagctttgtattgcagcaccaaggtagcttggtctggcacagtgtttggcaataggtccttgtatggtgctgccaaggcatcttgggccaagcggttggtgcagacattgaaaggcttactggggcaatgctttgcaccgagtccaagtcctcctgacccaccaaccataacaaatagaaacagagtgataacaaccaaggcagaccaaaagagcaaacagagagtccacgtgatagagtcaggatttccgggtgcactttggttgacttacaaagttcttgaagcccatcaccttcccatatgttgctttccttacaccaacaaagcattgcagacacctgatgccatgggagaggtgggggaaacaaatgggaaaatctccaaggcaaaagcatcctcagcagctgctgtgagtcccctggagttcccagctgtgggtttatatatcttactacaatgctgatttctaataccgtgtcataaaggggaaggagggcttccttagcttcttcttgactttaatggcaatgcctgtgaaatcttaaaggactacacactatactgaaaatgcctagtggaaaaaagacgccatgactaactgattaagaatccacagcagagacacttttcaaaagaagacatacaagtggccaagaaataaatgaaaagatgttcaacatcactaatcatcagagaaatgcaaatcaaggccacaatgtgaaaccatcttatagcagtcagaatggttattattagaaagtcaaaaaaacagatgctggcaaggatgtggagaaaagggagggttaatacacgattggtggtaatgtaaattagttctgacactatgcagagcagttttgattcctcaaaaaacaaaaatggatctaccattcaacccagtaatcccattcctgggtatataacaaaaagaaaataaattgttctaccaaaaaaagacacatgcactcgtatggtcattgtagcactattcacaatagcaaagacatagaatcaacgcaggtgcccatcaaaagtgggttagataaagaaaatgcagtacatatacatcataggatactatgcagtcatgaaaaaaaatgaaatcatgtcttttgcagcaacatggatggaggccattatcgtaagttaattaatgcaggaagagaaaaccaaataccacatgttcacacttacaagtgagagctaaacatcgggtactcatggatgtaaagatggcaacaatagacatgggggactatcagagaaggagggatggagtggagcaagggctgaagaacgaagtattggatattcctcactacatgcgtgatgaaatcattcctattccaaatctcagcattaggaaatacacccatgtaagaaacctacacatgaaatcccaaagtctaccccttgaatctgaaataagaataaagagtaaaaaaaaaaaaattaacagcaccatagtaccttgtacatgtgaatctacttccctttccatcttttacttacaacaatcctttgatataaatttccttgtgtattcaactccattttctatagttgatgaaatttctcacagattatggcaataaatgcctggcctcgttggcctcagcggtggagctctgcggccg

SEQ ID NO: 466268 - DNA, 1192 bp, Homo sapiens
aattcggcacgagggaaggtcgtgtttgcgtcccattctgccatgattgtaagtttcccgagacctccccagccattcagaactgcctgtgaaatcttaaaggactacacactatactgaaaatgcctagtggaaaaaagacgccatgactaactgattaagaatccacagcagagacacttttcaaaagaagacatacaagtggccaagaaataaatgaaaagatgttcaacatcactaatcatcagagaaatgcaaatcaaggccacaatgtgaaaccatcttatagcagtcagaatggttattattagaaagtcaaaaaaacagatgctggcaaggatgtggagaaaagggagggttaatacacgattggtggtaatgtaaattagttctgacactatgcagagcagttttgattcctcaaaaaacaaaaatggatctaccattcaacccagtaatcccattcctgggtatataacaaaaagaaaataaattgttctaccaaaaaaagacacatgcactcgtatggtcattgtagcactattcacaatagcaaagacatagaatcaacgcaggtgcccatcaaaagtgggttagataaagaaaatgcagtacatatacatcataggatactatgcagtcatgaaaaaaaatgaaatcatgtcttttgcagcaacatggatggaggccattatcgtaagttaattaatgcaggaagagaaaaccaaataccacatgttcacacttacaagtgagagctaaacatcgggtactcatggatgtaaagatggcaacaatagacatgggggactatcagagaaggagggatggagtggagcaagggctgaagaacgaagtattggatattcctcactacatgcgtgatgaaatcattcctattccaaatctcagcattaggaaatacacccatgtaagaaacctacacatgaaatcccaaagtctaccccttgaatctgaaataagaataaagagtaaaaaaaaaaaaattaacagcaccatagtaccttgtacatgtgaatctacttccctttccatcttttacttacaacaatcctttgatataaatttccttgtgtattcaactccattttctatagttgatgaaatttctcacagattatggcaataaatgcctggcctcgttggcctcagcggtggagctctgcggccg

SEQ ID NO: 466269 - DNA, 1164 bp, Homo sapiens
tctgagactttacttgggaaaggaggaacaaaagtgggtgaggatgaaggtggagctgcttgccactgagaggacagaacctgagaaacaaggtgtgatgaaaaagaagcaactttattcaagtgctactacttgggaaatggcaaggctcatgcttctgaaagacaatttcatatttggagctgatggggctgtcactaccccttctaggtctagagctttgtattgcagcaccaaggtagcttggtctggcacagtgtttggcaataggtccttgtatggtgctgccaaggcatcttgggccaagcggttggtgcagacattgaaaggcttactggggcaatgctttgcaccgagtccaagtcctcctgacccaccaaccataacaaatagaaacagagtgataacaaccaaggcagaccaaaagagcaaacagagagtccacgtgatagagtcaggatttccgggtgcactttggttgacttacaaagttcttgaagcccatcaccttcccatatgttgctttccttacaccaacaaagcattgcagacacctgatgccatgggagaggtgggggaaacaaatgggaaaatctccaaggcaaaagcatcctcagcagctgctgtgagtcccctggagttcccagctgtgggtttatatatcttactacaatgctgatttctaataccgtgtcataaaggggaaggagggcttccttagcttcttcttgactttaatggcaatgcctgtgaaatcttaaaggactacacactatactgaaaatgcctagtggaaaaaagacgccatgactaactgattaagaatccacagcagagacacttttcaaaagaagacatacaagtggccaagaaataaatgaaaagatgttcaacatcactaatcatcagagaaatgcaaatcaaggccacaatgtgaaaccatcttatagcagtcagaatggttattattagaaagtcaaaaaaacagatgctggcaaggatgtggagaaaagggagggttaatacacgattggtggtaatgtaaattagttctgacactatgcagagcagttttgattcctcaaaaaacaaaaatggatctaccattcaacccagtaatcccattcctgggtatataacaaaaagaaaataaattgttctacc

SEQ ID NO: 466270 - DNA, 347 bp, Homo sapiens
ctgaaagaagggtgaggttttgggggctctgatgtgcaagtgttgccacctttaaatggccccttactctcataatcagtgctgagtagtggcaagggggagaaaatggaaaagttggcatgggagagaaggcagatccagaagataggatacagctcagccctgagaatgtggcctgattttctcttctgttattacaactgctcttctgcttgagtttcttctacaccttcaagatggctgaagaacaagacgctttctctccatgtctatgctgtttcactatgctgcaaatattcccagccttttccccttgatgcccaaaataaattcctcaaataccctga

SEQ ID NO: 466271 - DNA, 762 bp, Homo sapiens
caaagaccagcggggcctgcgtgaaagatgctaaagacgaattacctcctctccctcaaagattccctaaaagcagaatcgagtcaattctcattcattcttttagggctcctgcatgcgaactccctgcagcctgcaatgctttctgggttttcatttctgtttccattttcaccttttccctcattgtcttgctgccagtctctaacaccactcctgacctcttccttccttctaacctgctgtgggatcagaagtgaggtaacaaagcttgctataattctaatttatcaacagaataaacagacccccgtcaatactggaaatgctctcccctttgcaaaatacgaaatgtcttttctaaatacacgcatgccttttagtgcctatgtaatccttatccatttcatactgtctgtgaactttggtgaatcatcagtctctctcttctgcagtgttgccacctttaaatggccccttactctcataatcagtgctgagtagtggcaagggggagaaaatggaaaagttggcatgggagagaaggcagatccagaagataggatacagctcagccctgagaatgtggcctgattttctcttctgttattacaactgctcttctgcttgagtttcttctacaccttcaagatggctgaagaacaagacgctttctctccatgtctatgctgtttcactatgctgcaaatattcccagccttttccccttgatgcccaaaataaattcctcaaataccctga

SEQ ID NO: 466272 - DNA, 3571 bp, Homo sapiens
tccgcgcagcccagccggcaccccgaagctcctccttcaccgggaacccaagcagaagaccgatcaaggaggtcctgacgacaggactcctatgggtccgaccctgggtctcccgcaggcccctctggtagtcctcttcccacccaccgcctggggctgcaccgcagccgccgccgcaagctccagcaccgccaccccagtccccgcagccgcggcgtcgccgccattttttaaagggtccgcagcctgactgccgagtaagggggggtggggcgggtgagtcggcctcgccagcgctcatgcgcgaggcccgagccgccgcttcggtcacagtgaccgccaccgttgccaagggatgggtccctgagacttggcgaagtgggagccctgtgtgatcgtgcgtcagagtcggggctgagaccagccccggccagggcagttaccgggacggtctccggaggccgggattcgcggagggtccaccagcaggaagaaaccccaggaggaagaaacctcagacagatcgccggggaggcagcgcgggatcccagcctcaggcgtgcgcggacggtgtgcggagtctagctttgtaccaggctgcagtgcagtagtgccatctcagctcactgcaacctctgcctcccgggttcaagagattgtcctgcctcagcctcccgagtagctgggattacaggcacatgccaccacacccagctaatgtttgtatttttagtagacacagggtttcatcatgttgcccaggatggtctcaatttcctgacctcgtgatccgcacatctcggcctcccaaaatgctgggattacaggcatgagccaccagaaccggacatgctttccttaaaagctaaatattttaggcttgtgtgccattaggctctgttacaactacttaattctgcttttgtaattctatagcacccattgataatacataaacaaatgagcatgaatgtatctcagcaagcagagcataaaagttcagaaaatttgcagcctgacaatgtgatagaagagaaaaacccattttctgaggagaaatttaagctggctgcagaaatttgcataagtaacaaggaactgaatgtcaatccccaagacaatggtgaaaatgtctcctggcatgttagaagtcttcacagcagcccttcccatcacagtctcagaggcctagaggaaaatggttttgctgggcccaggggtggaagccccaagccttggcagcttccatgtggtgttgagcctgtggatgcacagaaatcaagaattgaggtttgggaacatctgcttagatttcagaagatatatggaaacacctggatgcccatgcaaaagtttgctgcagggatggggccctcattgacaacctctgctagggcagtgaggaagggaaatgttgggtgggagcccccacacagagtccctactggggcaccgcctggtggacctgtgggaagagggccaccatcctccagacctcagaatgttagatccaccaacaacaccatgtgcctgggaaagccacagacactcaacaccagcccacaaaagcagccagaaggcaggctatatcccgcaaagccacaggggcagagctgcccaataccatgggaacccacctcttgcatctgcatgatcaggatgtgagacatggagtcaaaggagatcattttggagctttaagatttggctgcccctctggatttcagatttgcatggggtcaagaaatgaaaagcataaaaattgaaaagtgaaaagaaaaaatatttttattcacagaacttatgtccagctatgcatcaccccttcgctgatgagccttaagaaaatccaaatttataaattgctgggtccatctctctttccatccggaaaagtcagagcaactggtcttgctggttttaagtgttgcctgtgtttctggcattggtcacaaagcctactgcctgctaatcggcaagtggacctgtttctctaacaatggcccgaaacttcacaacatcaaaggagaaatcattgccagcaaaagcatttccgggtagtaggaaagaatacaagtgaataacattagtccagaagttttaataatattctttgctggttgaaattcatgtttaatatgatgtaaattacttgataagcaaattaagaactatgctactacagactccaaataagacgcaagaaaaatgaggggaaatacattaaaggaagatcttaaaaaacagctgcacagaagataaattatttttccaggagttttaaacatagttgcttttgtttgtttgctttgctgttttttcttaataattgttttaggctatccactatataaagatctttaaaaaggaaaacctgtaataaatgtgaagctagtgcctttctatttgcaagatgcacagaaatgcctgagaccaattgaaaattgcctgtgaacaaatacgcttccagatttttagcttgctcttttctaaacatgaaaattctcagaagcatcatgttttgtcactttaatccccattacttgttcttaattataaaattaaacatatttagtccttatccagaagcttcacatgatgtttgtcttcttgtcagtagggggaaatatctagaagataaatgactagattaagtggtaagcataggtttactttttaaagaagctgtcaatctattttacaaactggttgtcaatcaaaagtatattaaagtttcagttcctccattttcttgcctatacctgcttttatatattctttatgaaagtaatttattagtgtgttggggctccttatgaccacccttaggctcaaagattaactataatgattcacaggtcttagaaaacatgttacattcatagttacagtttactacaatgaaaagatacagattaaaatcaacaaagaaaaaaatcccatggggagaaatgtagaagatatcaggtacaagctttcaggtgtcctctcccagtggaatcccacaagaacacatgtaattctcccagcaacaatatttgacagcatattgaagtgttgtcaatcagagaagctcatttaagttttggtctccagggcttttactgggcatcagtcatgtaaggtggtgcctatatgagtgatttcagctactcagactacagcatctgtcagatcaaatatagccattgactctaaattatattgttaggataagcttaactgttcaaatgagcacagcatggtccaaggcctcagacgctgaaaaccacttgtgcactgtactctaaagccaaagatgtatagaaacactgtcatcaggcagaatatattaagggcccacagattatcttccaaaagccagccaagtgccagttctaaagacaaacattagtcctgatgagataaacctttcttggccaataagatatatgctattcaaatgttttctcagttcatagctttttaaaaaattatttttaaatgcccttttccattcctattaagcatagtattgaaagttctagccaaggcaatcaggcaagagaaagcaataaagggtattcaaacc

SEQ ID NO: 466273 - DNA, 2344 bp, Homo sapiens
tccgcgcagcccagccggcaccccgaagctcctccttcaccgggaacccaagcagaagaccgatcaaggaggtcctgacgacaggactcctatgggtccgaccctgggtctcccgcaggcccctctggtagtcctcttcccacccaccgcctggggctgcaccgcagccgccgccgcaagctccagcaccgccaccccagtccccgcagccgcggcgtcgccgccattttttaaagggtccgcagcctgactgccgagtaagggggggtggggcgggtgagtcggcctcgccagcgctcatgcgcgaggcccgagccgccgcttcggtcacagtgaccgccaccgttgccaagggatgggtccctgagacttggcgaagtgggagccctgtgtgatcgtgcgtcagagtcggggctgagaccagccccggccagggcagttaccgggacggtctccggaggccgggattcgcggagggtccaccagcaggaagaaaccccaggaggaagaaacctcagacagatcgccggggaggcagcgcgggatcccagcctcaggcgtgcgcggacggtgtgcgggtccagctatgcatcaccccttcgctgatgagccttaagaaaatccaaatttataaattgctgggtccatctctctttccatccggaaaagtcagagcaactggtcttgctggttttaagtgttgcctgtgtttctggcattggtcacaaagcctactgcctgctaatcggcaagtggacctgtttctctaacaatggcccgaaacttcacaacatcaaaggagaaatcattgccagcaaaagcatttccgggtagtaggaaagaatacaagtgaataacattagtccagaagttttaataatattctttgctggttgaaattcatgtttaatatgatgtaaattacttgataagcaaattaagaactatgctactacagactccaaataagacgcaagaaaaatgaggggaaatacattaaaggaagatcttaaaaaacagctgcacagaagataaattatttttccaggagttttaaacatagttgcttttgtttgtttgctttgctgttttttcttaataattgttttaggctatccactatataaagatctttaaaaaggaaaacctgtaataaatgtgaagctagtgcctttctatttgcaagatgcacagaaatgcctgagaccaattgaaaattgcctgtgaacaaatacgcttccagatttttagcttgctcttttctaaacatgaaaattctcagaagcatcatgttttgtcactttaatccccattacttgttcttaattataaaattaaacatatttagtccttatccagaagcttcacatgatgtttgtcttcttgtcagtagggggaaatatctagaagataaatgactagattaagtggtaagcataggtttactttttaaagaagctgtcaatctattttacaaactggttgtcaatcaaaagtatattaaagtttcagttcctccattttcttgcctatacctgcttttatatattctttatgaaagtaatttattagtgtgttggggctccttatgaccacccttaggctcaaagattaactataatgattcacaggtcttagaaaacatgttacattcatagttacagtttactacaatgaaaagatacagattaaaatcaacaaagaaaaaaatcccatggggagaaatgtagaagatatcaggtacaagctttcaggtgtcctctcccagtggaatcccacaagaacacatgtaattctcccagcaacaatatttgacagcatattgaagtgttgtcaatcagagaagctcatttaagttttggtctccagggcttttactgggcatcagtcatgtaaggtggtgcctatatgagtgatttcagctactcagactacagcatctgtcagatcaaatatagccattgactctaaattatattgttaggataagcttaactgttcaaatgagcacagcatggtccaaggcctcagacgctgaaaaccacttgtgcactgtactctaaagccaaagatgtatagaaacactgtcatcaggcagaatatattaagggcccacagattatcttccaaaagccagccaagtgccagttctaaagacaaacattagtcctgatgagataaacctttcttggccaataagatatatgctattcaaatgttttctcagttcatagctttttaaaaaattatttttaaatgcccttttccattcctattaagcatagtattgaaagttctagccaaggcaatcaggcaagagaaagcaataaagggtattcaaacc

SEQ ID NO: 466274 - DNA, 2360 bp, Homo sapiens
gtgtttagtagaaagacaatccttttttcttccagtcaattttttctttgatctacagaacttgcttcttttctctgaagttttcacaatacagcatgatagaaggagcacagagtgccagaggcagggaattcctatgcttcactagtgactcataagaaaacttaatagaaggtctctactgcctgctggccctgcagtacctgattgatgtggtcccaaactaaagtaggctaaccttcattgaaccaagcacttcagagccatgggaagaagtatgggggaaggagtccttgtactctggcaatgaggaaaacaaacattaacagtgcaagacacagtgagagtcacagatccatggatggacgatccttttgaggacaatagagggggaatttggataagtttcctgagtgagaaaccttccagatggcaatctgaaagttagctgttccttctcaaaacacagagctttctcaagagaaagataacaccctctttcatcagagcgagcgagccttctacaacaagatgtcgcagactgggtgacttaaaccagggatcctcaaaccctggcaatggatcggtacgggagcacaaaccctattgctaactgtacttgcaagggatctagactgcattttccttatgagaatctaatgcctgatgatctgaggtggaatagtcgcatccaaaaaccgtcctccacagtcccctccatgaaaaaaattgtcttccgcaaagctggtccctggtgccaaaaaagttggggaccgttggcttggacaacagaaattggttactcacagatttggaaactgggaagtccaagatcaagatggtgtgtgcggagttggttccttcaaatgtttgtggcctcgctgacttcaggagtgaagctgcatacccttgcagtgagtgttacacagctcttaaaggtggcccatccagagttgctcattcctcttgctgggttcgtggtctcgctgacttcaggagtgaagctgcagaccttcacagtgagtgttacagctcttaaaggtggcacgtctggagttgtttgttcctccgtgtgggttcgtggtctttctggcttcaagagtgcagctgcagaccttcatggatggcaagttcccccaggccctttggcatgtccagagatgctgtctgggagcaaagacttagagccaaaagccttagcagtttacctgatgtattctactgcagctaagctggcacccacaccacaatacaaagtccttcctactcttctctctcctctccacaggcagagaggcctccccctgtggccaccaccaccactggtccatggtggtgactggtttttgccaggccaccatgatgttcgcttaaagcccaagggctcttctgtcagcttgtggtcaatgctgcaaggcctggaactcacctgtaagggtagtgggatcccttctggcccagcggctgtgcctagaaccttagacatgaccttgagcccaaacaagataatgtgtgagaatagagcccacttaaaaagggccgcaactgagaagcactatgccctcactgaaagatgcaagtccggcttaaatatgcctggaaacctcaacattgaaaagtaacgcaagttaattcttggttggcagtaccttgagggcatctggaagaaacaaatgaaaattatctttacagagcccaccctaagtttagacctttcttggttcccacagataaatttacaccatggatgaactttcaatacgccaaaataaacaagcaaacaaacacagctctgtttttttgtcagctgatgctaataatgttttattaaagctctaaaggaaatgatttcttccaacataatattctgtgtactgcaggtcttttcttttgcattttgagtcactgaaagctaagctatgctttcagatggcctgcaaactgaagctagacaacttaaacttcagaagaaaataacagcaacttatttacatacctagaactataaataatgtatcattctttctatatctagtgagaaatgacaatgggtcttttcattctgtgcatttgtctgtctatgaacactagatcaggatctctcagagcctatattatttactgcttatagacgcatgtctgcaagctctttaaaactgtaaagcccctcttagctctagggccatattaaaagagactatgaagtaaatttagctcaggtagggcaataggggaagggagcagggcatagttttcctacttcttccctacactattggttgtctttaatccactaaagctcttcactgtgaagcacaagtttaaaaaaatgtaagaaaattacatattgcagttggcta

SEQ ID NO: 466275 - DNA, 2617 bp, Homo sapiens
ccagcctagatgaccgagcaatatcctctctcaaaacaagatgagctgtaccatagatttctggagtgtggatcgaagattttcataccagcagtagggtctcaaccttgtttttcttatctcttggcaagaaagcaaagctggccattggggtataataaaccttgtgtacacagctgcaggagggaacagggaggtggctgtgcttggaggccgggtgttttgccgacgataatggggcatctctggcaccatgttgctggtcggaacagttttggagttggattttgtcctgcagtgatgtctttgaagaggaaagcacttttgaatatttgcattgctttgaagccagtgccatggagatattgtgacttattgccagtcagaggcaaagctgagtgtgccctacgtcttccctgggagaagagtcctcgggggctttcctgtgggagaaaggaaggatctattcctgcccacacttctttctctccagatagagaaatagctcacatttttggtgcctactctgtactgggcactgtactgtgagttttcatgtgtgacctcacagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctggtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggtatgagtggctgtgactgtatgacataggaactatgaagcggggtgaggggacggtttggtgcgtaaatcctcacgcaggtggcggttattgtctgtgtggaggaaataagcccggttcttcctgggactgctttcatttccctctagcttccagagggtaaaatgaaccttaatggaggttggggggtggcacgcacaaagtcctgggttgagggggcagtggtcagaaagttccctagggtaatatacaaaggagaattaacactggggacactgaggtgggttttggtcctttccacataactgacacctttcaaagcaaggacttgctttctcgtgaggaatgtcagcagtcgcaacaccactgggttggatgcaggataattattcagaatcacgagttacctgtttgcaagcaatcacattgcaggtgggataaataagcagacagtctgtggtaggttcccccaccccaaccgcctcccctccccccagggatactgtaattttaagtattgttttggatattggtaattctaaagctccaatcttaactgggttttatgaaagccgttatagggtgtttattaccaaaaaaacctccttcttatttaataatacagtgcctagccactcctttttccctgcatccgtacatgaagcctgattgcagatctcgaacagtatatttctttgagctaaacagcaagaacagataaggtatcttatcaaaacccaccgccaggtggcgtggctcacacctataatcccagcaatttgggaagctgaggtgggaggattggttgaggtcaggagtttgaggccgcaatgagttatcgcgccactgcac

SEQ ID NO: 466276 - DNA, 960 bp, Homo sapiens
cccaagtggatgctactgccattaaggggcatttccttcaactcccacgtggaaaagggggcaaagtggaccctagtccactgtcactcacacacatgtacagatcccagggtccacacagatacagatcccaggcctccaccatgtccatctacgaagggctgtggcaagccatatacacaaagatgcctgtttcctgtcttctcggttaaaaacaaaaacaaaacaccggaaaaagccaagctgccatgggttgcagagtgccagcccttaagtagtgttgttcatgggggactggcagattattgcaaaaagggcacggggcagaaggactatgttgtgagcctgcgaaagaagtttgtgtggggactgtgggcagtgaacgcgttgggaacaatatggaaaactgggagctgccttggaatctacagggccgggtaagagaatgtccgaaagaaaaatgagcaggtgcgggatgtgcgcagagtcagagaagagtccagggcgcccggagtggctccaggaacgacggaaacccctcaaggcttttgggggcggctgaagaaaagaagaatggtattcacgcagttcccattttacagatgaaaacaagaggactttttctgtgaagtcaagaaagtggttacaatggtactttcagcctgtccgaattatgtattgcccctcccctttttattaataacattgaagtgtgatgggaaaaccactgaagccgtcagttgaaacctgctgggactttttagccattctcttcaacataaagaatgggtgtttttggagggggtgagaggaatggggaaatgttgtcaaagagtacagtgttttagttgagacaggaagaatatattttgttgagatctacagcacagcatggtgactgtagttaacaatgaagtattgtgtatttcaaaattgctaagacaataaatttcaaatgtt

SEQ ID NO: 466277 - DNA, 1173 bp, Homo sapiens
ggccaccaggccaggaggctgcagcaccagggaatctgtgctcacgtcttccaggacagtgcttcttctagaagctgacatggagctgaccacagctcttggaggcatggcctgaggcttagaaaatagacagagatcatctgagatttcagcagtggggccacgtggcagcgcccgaaggcctggagcaggagcgacccagggactcagagcagcatcttcttaggagacggaaggagagccgccggaggagcacggggcacctgcgatcgcgaagagcctcctgttctggatgggagcgaaggctccgagaggacctaaggttgctcagtgggccatggaaacggcagtgattggggtggtggtggtgctgttcgtggtgactgtggccatcacctgcgtcctctgctgcttcagctgtgactcaagggcccaggatcctcaggggggtcctggccgcagcttcacggtggccacgtttcgccaggaagcttctctcttcacggggcctgttcgccatgcccagccagtgccaagtgcccaggacttctggaccttcatgtgacgcccgagtccccaggatttgctccccagcccataaaagagacaaacactggcagagagatggtcccaggagagcagccgggaggaggcactggagttcagggctccagtcccagctctgctcatctggctcctatgacgagggttgtatccagtgtgtggacgtcccctctcctcaggctggaaaccctctgagccagagcctcatttttgcctcttttatatcttctgtttcccaggttgttttctttcatctcctcctttgtgttcacccatttgaaatcatctccattcaggagaaaacaagatggaacccagtgactggccaccatggacacatgcaagggagaaggagaagtccccagtaggaaaaggaatgtgtacaatgaaatgtaatgatgtataatacattggctgtttttgaattccaaccatggatttcccagctactggcagtgaaactgatcttttctgtgacacgcctgtccccctttgtcttctgccatgagtggaaacttcctgaggcctcaccagaagctgagcagatgctggtaccaaacttgtacagcctgtagaaccacaaggcaaataaatctctttttgaaaata

SEQ ID NO: 466278 - DNA, 442 bp, Homo sapiens
cctgcattgatatgatcttgtgatttattattattattattattttttgagacagagcaagactccgtctcagacaaacagacaaacaaacaaaaaaagtgttgtcttccaactcgccttgtttgttatggtctgaatgttaatgttcccccaaattcatgtgttgaaatcttaactcccaaggtgatggtataagaattgtggtctttgggaggtttaggaggattaggtcatgagagcagagccctcacgattgagattagtgcccttatgaaagagcctgagagagaccccttgccccttctgctatgtgagaacacagcaagaagcgccctctatgaggaacaggccctcaccagacactgatgctgctggagttttgatcttggacttcccagcctccaaaactgtgagaaataaacttctgttgtttgtaagtcac

SEQ ID NO: 466279 - DNA, 6561 bp, Homo sapiens
gagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaaggagcctcctccctctggccttaattctgcctcctgggggcttcccagtcaaatccagtccttctctcaagaggatttgaggatggccaccgtgtccctccttgttgcgaggaggttctcatggccagaggtgtgatgccgccaggcttcgggctcaccccacgagcctggtatggttatcactcagccagatgaagcttctggtctgcttccagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttgtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaattttttgtctcgcatattgtagatacctgatgtatatttttgttgatctagcaggtcattaaccgttaaggttattcagtctgcctcagacctcagctatttcagtgccatggggtatatttatgtcaataaagattttagtcaaatctctggaattcagcatccagagataatatagcaaggagataaagagcaagctggtgactttgggccagatactcactcttactgtactttctgtacctaatttcctcatgtattaaggggggagtgtgataataagggggattaacgggagtgattgatgtgaagcacaaagcctggtccacagtaagggctcagtcagtgggggcgtttcttctgcagctgctggctgctgttggctcctagtttatgttatcctatgttatcttatagttgagtgtttttacacttaggtctgtgattcattttgagttagtttttctgaaggttgtaaggtctccatctggattaattttttgcatattgttccagcaccatctgttgaaaagactctctttgctccattgtattgcctttgctttttttttttttttttcaaggatcagttgactatacttatgtgggtctatttctgggctctctatttgttccattgatctatgtgtctgttctttcccaataacacactgtcttgattactgtagctttatagtaagtcttgaaattgggtagtgtgagtcctccaacttagttcttctctcccaatgttgatttggctattgtgtgtcttatgcctttccatgtaaactttagaatcagtttgtcaatatccacaaactaactcactgtttattttgattgggattgcatcaaatccatagatcaagttgcaagaactgacattttcacaatattgatttctatccacaaacatagaatctgtcttcatttatttagttgttctttgatttcttttatcagttttgtaggggtttttcccttttcctacagtttttttttttttggtaatttttcttatagatcttgtacatattttgttagatttataagatttatacctaaatatcttatttttgggggtgctaataaaaatagtattgtgtatttagtttcaaatttcatttgttcattgctagttatgggaaagtgattgaattttatctactcacattgtatcctgcaaccttgctataatctcttattagttttaggagtttctttgttgattcttttgttgatgagataatcatctcacctgtaaacaaagacagttttatttcttccttcctcatctgtatatctgtatactttttatttccttttcttgtcctatttcattggcttggacttccagtatgatgttgaagagtagtggtaagagggaacattcttgccttgtttatgattgtagtgggagtttctagtgtctcactattttttgtttgtttgtttgagacagagtcttgctctgttgcccaggtggaggttgcagccagccaagatcatgccactgccctccaggctgggtgacagagcaagactccgtctcagacaaacagacaaacaaacaaaaaaagtgttgtcttccaactcgccttgtttgttatggtctgaatgttaatgttcccccaaattcatgtgttgaaatcttaactcccaaggtgatggtataagaattgtggtctttgggaggtttaggaggattaggtcatgagagcagagccctcacgattgagattagtgcccttatgaaagagcctgagagagaccccttgccccttctgctatgtgagaacacagcaagaagcgccctctatgaggaacaggccctcaccagacactgatgctgctggagttttgatcttggacttcccagcctccaaaactgtgagaaataaacttctgttgtttgtaagtcac

SEQ ID NO: 466280 - DNA, 1242 bp, Homo sapiens
ggaagtccgcgtgctttgataccctcagggggcacttacaggctaggtggacacagggctaggggtaagaatgcagcagtgaacatggttcctgcactcatgaagcaaatgtatccactgtggtacaaaagagactgtaaaaaacaaacccaaatggacaacagcagggttaaacattgcagaagaggtgccaccttggatagtgttatttgatggaggccaggatgatgcatctgtcttctctctgaagtgccttacaaaacattacgagcgagtaggtcatcaaaacaaaacacaaagcatgagttgcaaagggaaacatttagcttgcaattcttattacatctttattatcagtcaaggtcacagtcatattaaaaatatataatttaattctcaaataatgtctttgttctgcagctccccaagtgcagcagagcatgccccaaggtgctaggccccatgcgctgctctttatcccacaggaagaggcctcctctgccctgttcttacctcttttgactctcaactctgaatattggcttgtacagttctggaattttccgctcgatcattggcctgaggactggctggatgagtactggctgcagcaaatcaggctgccaggattctttatggctgtttctgcttccactacagctgagtcagaaaggtcgctgccccgtggtggcactagacgcagtggacctggcaagcaaatgtttccgctattagctctcagcaacagagactcatttatggtcaccttggaaatctgggcttatcgatctacagcccaacagagtggaggagaaaatacacagcacaaacaacgtgaaaaaatagttactctattcattaaaagctgtaacttccagattggacttgagaagcaattaagcaacagaggaacctcatctactatctgtattcaggcatgctcatgagaacacgctgctccagctggacttagaggaacccggtgcatcacaggcattcctgacagagtctcgtggtcctgctggtccactcagtggtactcagtcctcctcattctcggggataggttccaagacccccaggggatgcctgaaactgcggatggtaccgaaccctacatatattatgtttttttcctatacatacatacctatgataaagcttaatttacaaattagatagagtaagagattaacaacaattacagcaatatactgaaataaaagttatgtgaatgtggtc

SEQ ID NO: 466281 - DNA, 915 bp, Homo sapiens
ctaggttactttcttttgtaatcacaaaatgcattaggtatggatcagcatttcagcagagttctcttacatgctatatatgagccaaaataaagaaaatgtcccagatgaaaataaacttttctggaaaagatggtgacttaaagtcatattcagtagaacctgtgtacatattattattttccatacttcaaattgattgaccagtttatggagttgatagagtgctagatttaataggctttgttgacagacacttaggaaaagaataccaggcctgattgttcttcaaagaatcaagtaggaagcacaccataggttggtgagcctgacttcagggtgaggcagattctcacaacactttaataagacatgaggtcagaagaaaactggggaaagtctagtttgtcttgaggattcctcaaacatcaagttgagcctgaaatatgttgatgcaatgatcagatagcatttgagaaacccagaaactgtgggcgttttaaaaaataaaacacaaagaactggatacctaaaagctgatcaacaaatgaagtgaaaaaatagaagagataaacttaagaagaaaaaagagtatatagatgacaataaattatgaactaagaggagaatattagctggcaaataaagaattctatctagaaggttactgctgcttttttagctttgaagagtttattataattggtagaactaatataatttattataattggtagaaagtaatgtgttctttgcttagcattgccaaaaaatccataaacacaattggttctcttccctgccttaaaaacttatttatgtatatatatttatgtatatttatagtaatgtgtatgtgtatatatgtgaatatatgtgtgtatatatatgaatagagtaaatatatttgagttc

SEQ ID NO: 466282 - DNA, 548 bp, Homo sapiens
tcttacagggccagcaacataggtaattttatggtgcaattcagctaccagaccattttcatgagcttgtttgctggagtgggtatcattaagatgatttctaaataagggcacaatgtgagaggaagtgtgttgggatgtggtttgttatctggggcaaaaggtgggtggtgagagttcatttgctgatgtaaggaagtgcagagttttttaatagctgcctttgttttgctcacctccgactcacctcctatattctcttgctggaatgtagctataaaaattgattttttttctttttcttttttttttttttttttagcccaaaatttcaattgctgcaaccttgacaattcagcttcttaggggcttcctcgtgtccccagaagattctcttcaaattggccccaggtcaagggagcttcctcaccatcacggggggcagggggcatcccttttccagtttgcaattgctttttttccaaccagctattgcttggaccaccagaccgacctttggcttcccgaggggtcccgagctcgaatcc

SEQ ID NO: 466283 - DNA, 5836 bp, Homo sapiens
agcgataaaaccaaggtcctgaattccctggatgctctctgctgagggttgatgagtgtcaccagacttcgacctggagcggaaacagctcacttgaattctccgcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttttttgtatattgatgaatgagatcttacctattaaatatattattggattatg

SEQ ID NO: 466284 - DNA, 2933 bp, Homo sapiens
ggctgctgctcacttagtctggcacagatcacagaatctcccttttcaaagttgagacacttgactttgtgctgaaaatgtctttttagctgtttaaattttcattctcttccctttacttcttgattattttttcaaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttttttgtatattgatgaatgagatcttacctattaaatatattattggattatg

SEQ ID NO: 466285 - DNA, 3382 bp, Homo sapiens
  misc_feature (36)..(36): n is a, c, g, or t
  misc_feature (93)..(93): n is a, c, g, or t
aatgccactctttattgggggctgaacaccctcaanttaagaaaaccacccgcttttgggttttgtttaaataaaagcagctgacgccgaatnccgggatatgcgaccacgctcggatacgtttcaggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttttttgtatattgatgaatgagatcttacctattaaatatattattggattatg

SEQ ID NO: 466286 - DNA, 1527 bp, Homo sapiens
ttttttttttccaataatatatttaataggtaagatctcattcatcaatatacaaaaaaaaaaaaacaaaccagaaaacaaaaaactaactttgattaagacatgtgcccttagtaagggcacttacaattagaaaggtttatcggtagcactttgaggtagcatattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttttttgtatattgatgaatgagatcttacctattaaatatattattggattatg

SEQ ID NO: 466287 - DNA, 3427 bp, Homo sapiens
agcgataaaaccaaggtcctgaattccctggatgctctctgctgagggttgatgagtgtcaccagacttcgacctggagcggaaacagctcacttgaattctccgcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagtatgtttctgttactgttatttcaaatagttgagcaagtagtaatttagtggagaaaaagaataacttatgtctcctttgcagcaagcaaagaaagccaattttacatactttgcttctcttgtggggaggctgtatattttgtgttgatggaattaaagagattatacaaattg

SEQ ID NO: 466288 - DNA, 784 bp, Homo sapiens
acagaaaggcttttaagatactggtaatgctgtttcttgatctgcctctggttatgcagataggtttcgtttgcaaaaattcagtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtattttatatatgtgtgtggattgcgttagaatcttgggttgaaacctagaaatctgcccttcaacctaactagtggaatgagtcagagaacctggaaatgatgtgtgacaaagatggcattaaaaatcagcatgtaaatgataaattattcaataaataatgtgagaaaaattggttttccatatggaaaaaaatgtgattagatccctacctcacaccgtgaaacaaaataaactccatctcacatgaaaagtatattcatcccagtagcccccaaagttttacctgattccagcatcaactttaaaatctaagtccaaagtatcatctaaatataattcaaatcagatataggtgagactgaagggaagggaaaagatgccataccgttttctgaaactctaaagataaaaatctttcatagaattgtagtgccggaggatctcagaaaacacctagttctagagtgtcatgtttacagattgaatgactagttaatgcaagtcacatgtgacaagccatggtcaagtgtgttattctttg

SEQ ID NO: 466289 - DNA, 466 bp, Homo sapiens
ctaggtgaacgtacgtaaatgatttggtttatgtatgcgttaccccttgtaagagcaacgtgtgaagcccatggtggtggggtggaagagtgggaattggatggaaaatcatctagacttttttctttttggagttctgcttttatctaatatttctattcagcagtcagttcagaaagatactcagtagaaagatactcatgctgaaggattgaaattggctctgactttctaaatttcacatacaggtccattgttctgttgagcacaagaggagaaataaagcagttaaacatttcacacttactagtacctctgggattagccaaaccagctcatctttatgacaaaggtttgtatttgtattatttcatgaagttcttacagggccagcaacataggtaattttatggtgcaattcagctaccagaccattttcatgagcttgtttgctggagtgggtatc

SEQ ID NO: 466290 - DNA, 552 bp, Homo sapiens
tcatttcacctttgtaccatcatttagtggcttgagaggtggttctctgcctaagcgcagacttgtcttttgttctcatggttggagatttggaaacgaagaccaaagtacctgaggttccgaataaaagatcttaactgagttgattctaggaagacaaagtcacctcttcagagaggcctccattctgtctaaaatagcatctttctccccacccaatctatgataatgttgtgtcttatggtctctatagcacttattttctgaaatgatcctttgtttttctgtttgtctttcccactacagcatatgtttcattcaatcaggtatcttgttttggctcctactgtatcctagaattttgcttagttcataccggatatttagctgtcttcataaaacaagtaagtgaagtgctgctaaggggacagcccatatgcattaaacaaaatcttgtatttccacaggacgttcccaattagaggctttcagatttatgatgggcccattcatctcacaaggagcactttcaaaaaatatgtgccaactcca

SEQ ID NO: 466291 - DNA, 391 bp, Homo sapiens
aaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggtaggcataccttcttcccagatccctatcagagtccgtgtctgtgtgagaggagagtgagggtggggaaaggagccacagccacagcatgactcaggcatcagaagggccactctaccatttgcatgtctggta

SEQ ID NO: 466292 - DNA, 731 bp, Homo sapiens
gaagtgataagctaaaatctattttcatgaatcattgtatatgttgttgtaagttgggattcatattcattccagtccattatttatatttttcaggctggcttatttattgacaaaggtgtcaaaacaaccaactctagtgctgctgacccaagggaatacctctgtttggacaatagtgcaaggtaaagctggctcttttaagtcacactcaagctatactttgccaaagcaaaactttctaactggagtttattgtgctctttctgtggtaatacatttaaaataaagttttagaagttcgtaaaagggtttttggaaaaccacttattctgttgtcccaggtcctgtgactggtcttttatcttattgaaatactaaagaggttgatgtttttctcctttttcattgctataaatagatgctagagagagttgcagaaagagaaagaaaaaagaggagatatgttgagaaagtttccaaatttggtgtgcagtatgattcattgaaaaataagttaaactaagatgtttagtctcatccttgaaaaaccaaaccatatagaatttattctttgtggtcaaaatgaatactgcatttaatatttcaaaaggaatgatcccaaatttgatgagcaacctggttctggttcagccctttgtagcctcagatttacatcatagccaggctctaggttactttcttttgtaatcacaaaatgcattaggtat

SEQ ID NO: 466293 - DNA, 6588 bp, Homo sapiens
agcgataaaaccaaggtcctgaattccctggatgctctctgctgagggttgatgagtgtcaccagacttcgacctggagcggaaacagctcacttgaattctccgcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttttttgtatattgatgaatgagatcttacctattaaatatattattggattatggttcctgaaggtcattaaagtttgagtgtgtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtattttatatatgtgtgtggattgcgttagaatcttgggttgaaacctagaaatctgcccttcaacctaactagtggaatgagtcagagaacctggaaatgatgtgtgacaaagatggcattaaaaatcagcatgtaaatgataaattattcaataaataatgtgagaaaaattggttttccatatggaaaaaaatgtgattagatccctacctcacaccgtgaaacaaaataaactccatctcacatgaaaagtatattcatcccagtagcccccaaagttttacctgattccagcatcaactttaaaatctaagtccaaagtatcatctaaatataattcaaatcagatataggtgagactgaagggaagggaaaagatgccataccgttttctgaaactctaaagataaaaatctttcatagaattgtagtgccggaggatctcagaaaacacctagttctagagtgtcatgtttacagattgaatgactagttaatgcaagtcacatgtgacaagccatggtcaagtgtgttattctttg

SEQ ID NO: 466294 - DNA, 3865 bp, Homo sapiens
aatcacacttgatcaagtttttttagaatcttgacttcctttggtttggaaggactgggtttgctgatagagattgaactgctacctggaagttagactttttcattcatcttggcagtgggaagataattcagaatgggtgggatggactgttcattttgcctggttttggccctaatatagaccgaaggaacccaggtccatctgctcttcataaatatcacaggaattgatttgagactttatcttggccttagccaaagaagtcacagttcctgtttttattatttcagttttatgccttaaccaaatgatttatgaatgagaacaacaaaaagaatgaaccacactaatttaccaaatcctaaactcaacacattatgtataaagtgttccaaggaatttttgagccaaaccaaatttcatccccccaaattacctatcgaactaattcaaaccagaaatcagctttgatatgttccacaacaatggaagcagggtatgacatatttcctaaagtgttactgcatttgacttaggacccttgaaggatagaaagaaaacagaaataactattcattttgtaatttatgttttaaggaaaagttactaattggaggaatatcccttttggccatgagctgatttgaggaattttgtaagtttttgagaataagtctaactacatggattggtttctgttttgtgcaggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttttttgtatattgatgaatgagatcttacctattaaatatattattggattatggttcctgaaggtcattaaagtttgagtgtgtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtattttatatatgtgtgtggattgcgttagaatcttgggttgaaacctagaaatctgcccttcaacctaactagtggaatgagtcagagaacctggaaatgatgtgtgacaaagatggcattaaaaatcagcatgtaaatgataaattattcaataaataatgtgagaaaaattggttttccatatggaaaaaaatgtgattagatccctacctcacaccgtgaaacaaaataaactccatctcacatgaaaagtatattcatcccagtagcccccaaagttttacctgattccagcatcaactttaaaatctaagtccaaagtatcatctaaatataattcaaatcagatataggtgagactgaagggaagggaaaagatgccataccgttttctgaaactctaaagataaaaatctttcatagaattgtagtgccggaggatctcagaaaacacctagttctagagtgtcatgtttacagattgaatgactagttaatgcaagtcacatgtgacaagccatggtcaagtgtgttattctttg

SEQ ID NO: 466295 - DNA, 4961 bp, Homo sapiens
  misc_feature (4776)..(4776): n is a, c, g, or t
agcgataaaaccaaggtcctgaattccctggatgctctctgctgagggttgatgagtgtcaccagacttcgacctggagcggaaacagctcacttgaattctccgcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtaggcttagcaaatgtataatgctcaagttcctaccagctcctgccagcactgcttctgtgagaagtactcttcagcttttcagtgtgattgacattttccaaagtatgatctatcttcctgtcctgtcctgtcctttcttttctttctttcgattcattaggagtcatggactcctggaatttttcttaaaactccccaactccagatctgtttaagaggtgaaagagtgagtcccagagaggagagctgatttaccctgggttaaatgtggttggaacgtagttgggacaagaacccatgtttcttgactcttaggttttcttgccacactacagctatgccctctaagagggatttttatcctttgcttttggggtcagtaatctctacttaatgaaagaatctgacttttgaggcaaaatatcaataggtcacatgaaaagtgagatgttcccggggacagagctggagatcaggagtgagtggacaagaaaggaatccaaggaaaatttcctaattctattatgatataatgtctatgaaaatatggaggagatgatatacattgagaaacacctctttgaagacattaagcattaatgtgtattaacttgatgcctagtataagaggatgaactaatttgcaacgtagtatatatggttaagagcacagattctagagctagactgcctgggtttgaattctggctttgttattttctaaagtatgcattggaaaagttaattaacttctctatgtcggtacacaatggggataatagtagttactctcataggaggctgttgtgaagatagagtacatgcacatatgtaaagcatttagcatatggcctggcacatagttcagtgcccgctgctcttagtattatttaaggagaagagctgtaagttgcaaaggtgattttaatagtgacattttggtggatggaagagattgcagaatggaggtaccagttgcccaggattttgaaaggagcagatcctgcccccaccctctgccccatgcagacaattaaagggtaggaatttttatttatttatttatttttgagacggagtcttgctctgtcgcccaggctggagtgcagtggcgcaatcttggctcactgcaagctccgcctcctgggttcacgccattctcctgcctcagcctcctgagcagctggactacaggcgcccgccaccatgcccggctagtttttttgtatttttaatagagacggggtttcaccgtgttagccaggatggtcttgatctcctgacctcatgatccgcccacctcggcctcccaaaatgctgggattacaggcgtgagccaccgcgcccggccaggatttaataatagactgtcagaggagataaaggaaatagatgatcagaacatggagacgagaattagaggaagagcaagggattttccacatagaattgggctgtgatagccctaaagacaggaaagaagcccctttctttgatttgctgctagatgttcttttcgtagcatgggctcttcctggggaggatccgtgctgtgctatttcccctctactgagctctgctcactttgccggtcaaaggtgtgttttcaggctcccgcttgtcacttctctgagccccctgaattacatgttgtttccaccacctgagctttcaataattggagcttcttggatcagaattcttctttgttcttctgactttgaattacgncaattaaagcaggtgatttttaaattttaaaacttaaaaagtttagatccttatctatagactaaacaaagggcttaagaggaataaagacgggagagactttctggtttattttagtgggggtattagcttctttattgctatgggatttctcatttccatgagcaaaaataaaaaatactaaa

SEQ ID NO: 466296 - DNA, 3690 bp, Homo sapiens
agcgataaaaccaaggtcctgaattccctggatgctctctgctgagggttgatgagtgtcaccagacttcgacctggagcggaaacagctcacttgaattctccgcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacgggagacggtgtatccctatgttgcccaggctggagtgcagttcacaggcatagttgtggtacactacagccttgatctcctgggctcaagtgatcctcccacctcagcctcacaagtagctgctgccaccacacccagcattgattttcaatttttgtttagacttaaacaactacctggactttcattctgtagatgatagaacttccagattcccacttgattttccacaagaataaaaagaatatccacatttgg

SEQ ID NO: 466297 - DNA, 1134 bp, Homo sapiens
gactaggaagacaagaatttgacctagagaacaaattcaaaccattcagagcacctaaagaattgatttactacttcttggaaaagtactttccgagcattaattatacactgattgacaagtatgaaaaatgtattctgagctttttgtggagatagtggacccagtggatatctatcttaacctccttcagaccatctttgactttcatgccatcaagagtttgctgactgggcccagccaactgaagattcgcgttgatgcaatgcatggagttatggaaccttatgtgagaaaagttctgtgtgatgagctgggggccccagccaattctgcaataaactgtgttcccctggaagactttggagggcagcaccctgacccaaacctgacatatgcaatgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccatcagatgggggtccgcgggtttgggaggagtatgccaaccagcatggccctggacaggagatccagggaaggactcttggaggagattaggcataggaccaaagatcagaaacaggtatctggacctgactgtgatgctgggattagaaatgacacccacacatgtgaaaacacttattcctcagaagaaagagtaactgcagtaattaggacccaattgatggcaaagggatatgatctagcaaacttcactgccaacaaaatgtgttaatattctctgtgtaaggtgttctgctagattcagggaggtccgtggcttcagcgtgaatctgaaggatagagctggggagtgtttttaaatcatgatgacattgttcataaagattgtgtcacacagattctactacctatattttggggtgggagggagagacagggaatgtagtttaagaaaagcaagcatttatgtctgccagtgttctcaaatgagctcatgtatgaagtgggacatggaactcgctgacctttattggcctctgcattcagactacctggggttgaattctaact

SEQ ID NO: 466298 - DNA, 1371 bp, Homo sapiens
ggaggcacgggcaagctctggggcccactccttgggcagcgcattttggaccaagtcccttagcgttcctggctgcctctgtttctctgcctgccttgggaatccagacagcctcatgacaagaggagatgaggcagtggttgcggaagagcctggtctctcagccacagcagccacgaggagcaggaaaaaggccgtttgtcgtaagggtcactgctgttactggtcacctctgggtgcgagtcctgggctaatcgcatatcttgcgggaccctgacaactcccccatttatcagatgaggcaaagcaaggctcagtcacttgcacaacgcatatcgctagagtgccgaggaaacgctgtcaagatgtcaaaaatacgcggtaagacgtcagcccggtgagcatcctccgcactgcggaccgcccggggtcggggtcacccgggccccgccccgagcttgctgtcgtatcggccccgccccacccacgccctcccggcccctcctgctccgggcgcgctcggctccgcccccacgggcaacacggcctcccattggccgcggtttccatggttacgcgggccggcggagctgcgggctcccagacacgtgtccccgggagccgcccagaatttgacaggggaccatgtgcgcggcagcgcgggagcgagacaaaggaccgggggaggcggggaacgaagccgggcggaggggtccgcgtggcccgggcggggatgggccccgcgcttctcctgcgagcagggcaccccctcttcctttttattttgaaggaaagggaaaaaaggaattgctacggaaagagaggtgggagaggaacccagtcaatttcacctgctccccttcctccaggaagaatcgggtacgcgggcatctgagaacccgcagggtttctgcttatgcctcccggccctgagtttctaaccccacattgacctcagaccttgaggtttaaattctgtttctctgtcttgttctagaaccgaaagcttaataagtgtggttgttttgatattcgaatcatgagacccaaggcatcgtaggggacctcgcctgcatccattcgcctatccatcctacagcagcgactgcacccctgattgtgatgacgaatgcacccccatccttgggctccgtgcccactgctgggctgggctgctccctcaggtgcggcagccagaggaggtgtggactcccatcccacgcgtttatcctcctgcagcctctcgagcttggtggcatagccgtccttccagtccccaagccagatgtccttgatgccccttctcccagccccatccccatcgccagttgtatcagttttctattgctactgtaacaactcactacaaat

SEQ ID NO: 466299 - DNA, 3532 bp, Homo sapiens
ggaggcacgggcaagctctggggcccactccttgggcagcgcattttggaccaagtcccttagcgttcctggctgcctctgtttctctgcctgccttgggaatccagacagcctcatgacaagaggagatgaggcagtggttgcggaagagcctggtctctcagccacagcagccacgaggagcaggaaaaaggccgtttgtcgtaagggtcactgctgttactggtcacctctgggtgcgagtcctgggctaatcgcatatcttgcgggaccctgacaactcccccatttatcagatgaggcaaagcaaggctcagtcacttgcacaacgcatatcgctagagtgccgaggaaacgctgtcaagatgtcaaaaatacgcggtaagacgtcagcccggtgagcatcctccgcactgcggaccgcccggggtcggggtcacccgggccccgccccgagcttgctgtcgtatcggccccgccccacccacgccctcccggcccctcctgctccgggcgcgctcggctccgcccccacgggcaacacggcctcccattggccgcggtttccatggttacgcgggccggcggagctgcgggctcccagacacgtgtccccgggagccgcccagaatttgacaggggaccatgtgcgcggcagcgcgggagcgagacaaaggaccgggggaggcggggaacgaagccgggcggaggggtccgcgtggcccgggcggggatgggccccgcgcttctcctgcgagcagggcaccccctcttcctttttattttgaaggaaagggaaaaaaggaattgctacggaaagagaggtgggagaggaacccagtcaatttcacctgctccccttcctccaggaagaatcgggtacgcgggcatctgagaacccgcagggtttctgcttatgcctcccggccctgagtttctaaccccacattgacctcagaccttgaggtttaaattctgtttctctgtcttgttctagaaccgaaagcttaataagtgtggttgttttgatattcgaatcatgagacccaaggcatcgtaggggacctcgcctgcatccattcgcctatccatcctacagcagcgactgcacccctgattgtgatgacgaatgcacccccatccttgggctccgtgcccactgctgggctgggctgctccctcaggtgcggcagccagaggagcctgcccagccaggatatgcggcaggaggttcatttttgaaagtataagaagggccgccgggaatgagtgtctcacggggacagagtgtgcgtttgggaagatgagacggttgtggagatggatggtggggatggttacacaacaacgtgaatatgcttaaagccacgttcacggaacacgtacaaatgactaaaatggtaactttctggtatggatattttaccacaataaaaaaaaaatgctaaaaaaattgtaaagaaaaagtgctttgtgtttgccgaacttttgaggatgggccgcccactgcacatttgccgtttcccaagcgcctcccacgggccaggccacgcacttcctcctttcattctggaaacaagcttgaggagagaggagcgtccaacccccaagcaagaggaaagggaggggaaggtgaaggcaacagagttcttgatcccagggtatgagtcgctgcctaacacccagacctggcttctgacagaagcgccagcaggaatttcccgcacctccggtgtgaatcctgtccagcttcctgccattggcttgaattgttgcctggcactgttctcgcccagaaacacagcaggaaaaagagacaaaactttctgccatcatggcctctacgttctagtggagggagatggacagggagttgggatctggtgcaagacagggttgcctgggggcctgagtgtcgatgtctggaagcaggaaggtggctgagggacaggcccaggcacccaggggtagaagccaaggtgaccgtccctgggttttatccttcttgtctctgtccctctgaaataaaaagcagggtcgccagtggggagaggaggggtgacaaaaccgaaagtctctctttttttttttttgtaaagtcgtctcttacaggaaaatatgtggtcctttcaaagccctatcccttgtaagggtggtttctctgcactcgggggggtctccctcctgtttccttttgaagatggtgtctggctgtgtggagaagcttgcatgggccaggacaggagtctcttgccctacttgccatcactggacctgctcaggaggggcgggtctggtctgccctggtctccgggaaccgcatccacgttctctgaggctgactggacttcgctttgccctgaaaacttccaattcacagtcaatcttcttcccatatgttgtttttttctgtggctgctctaataaagtcccacaaacccggtggttgaaaaccacagaaatgtgttctctcacagtcccagaggccagaagtctgaaatcaatgtgtgggcagtgccgtgcctcctctgaaacctctaggggaaggtcctttcttgcctttccggctttagccccagacttacaaatgcatctctccactctctgcctccaatgtcacatggcattttcctcttcttctaagaacaccactcatattggattaggccccacctaatgacctcttcttaattatatctgcaaggacctttatttccaaataaggtcacattcacagctgcaggggttgggggtctctgtgagactgtcctcagcccctctgcctggggactggggaccctcagtcatttccatctgctgcagcctggccacactgggtgcaatgtcaggcctaagaaatttctacatgaactgtcccttaatttgcatataattaaaagtgggtatcactatgagtgcagaattggatctgagctgccactctgggcacacagcctgcgggggagccctgctctgcagggagcagttcctccgctgggctaggcatggccactttaatacaagctgttgtctaacaccaccagctcacccttacatactttcctgggtgaagccaagaaccctcctgggttaagccccagttttggggctcatctgccccgcatcagtaggaacccaccaagtgtgggaagagggaatggaagccagcggaagtgatgccatcattttgtatgatgtttactccgtgaaagtgccgacatgcagctgttgtcaacctacaaacatggcaactgcttatgatcaaagccctcctcaagcccccacttttggtagacccccatcacttggtgatggctcagccggttctaccttgagtgagagcgtccttccctgcccgggccccgtgcacctcgcttcctctccaccttcccctggcttcccttcacatggccccatctctcctgcgtcaccagctgtttcctctcctgggtcagccccatcagcatgccacaaacatgcaggaatgcccccagattgtaagaagccaccctctgaccccacaatccccttt

SEQ ID NO: 466300 - DNA, 4292 bp, Homo sapiens
gagatagagggatggttgatctcatgctaatgaagtttagaccatgttgagccctacttttgttctgtgggaagttggatatcccttatacatctatggctccatcttcatcgttattgtaattatctggcaagtgaaaaggagccaccatgaattgagttcagaacctaaaaggagctgctgccggtgtcaccaaaaagtcaggcaaagagctagagatgcagcatcaacagctaggagacgttcccgggaagaagctgagaagccacagaagctgctctccatcattaaaagccagggctggcttcctctggagagaagtgtgcggcgaatcctgtgtgcagatccctgctgccaaatctgcaattctgtggctctggagattcagcaattgctggtgggtgagaacaaccagatctccctgactttatcggggccattgcagggctcctcttgcctagagatgctgtctacgtctagtatgtctttagatcagagtctggagtttcattcctggcacaccagagagctttcactgtcatctgtaaccccaacactgtcacaattaacagatcagaaatctttaacccagtcagctgcccagtcaacgtatgcagatggcatacaagattactgggctgatcacctccagctagggcaggaatttcaagtgccagatgtgctccggggcccaaacaccatagcttcttcaaggattgagaagccaagggctccactgaaccaggaggagatgacgcagagcaaccccagccttgtccagggaaaccaaggccagcatcacttgaattcccaggtctccttgctgtccctgaacccagaaaccctgaaccggatgcatccaatggccttgcatatggtcctccctgcccacctgccatttctcagtcctgaagtgctgaggcttcttgaggtacatgttaaaaaatggatgcatttccagaggtgggggctcccaagacgtgtggaggagtccctgaggcagcttatgccaaacccaccattgtattaccaacctggaaatgaccagccagtttctttcaacctgaagaatactcctcaggtctctcttcatagatttgagaccatttccctccagacctggtgttcatgtgtggctggccagcccatccagaccttctgggtttctgaatggtccacaatgaacccagaacaaagacaccactgtcagcaaactccaaaccctatggctctagccttgccctctccagcccttaaagccctaagtggcccccatccacagtctgggggacaagataatgactcagggagtgatctccagcagaaatacagccagctattctgtgggctcccttctctgcacagtgagtccctggttgccactttcatgggatctcaaggcctccccaagattgaaaatgtgcccaagccccccttgaaggatccttttctcttcaatgagctctccttcccccaactgctccctaaaacttcaccccagtcagccccaccctcttccccactttccccaaactggatgtctccatctgaccatcaacgagctcagatcaatgtcccatttctgactctggctgagtatgaagccttggagtggcacctgctacagaggcaactccagcttcagtggggctggccagctgccctccagaggtctcagcacacccagtgcctcatgcagcatgagccctgtggcaaagctcagtctcctgagaccacgacagcttcccagacagggaagtccatctcagtgctcaccagggaactactcttcttcccggagcatgcccggaagctgctggaattccacatccagaaacagttgattcgccatcgctggggcctgcctcagaagatccagcagtccatccagttgctccttacctccactgatcagcagactgtgtccagcagcagcacagccctagccaacgtgagcatcccccagcctgtagccctagaggccaacggggcttgcgatgtgctgtcacccattgcggccccagtgtccatccccaggccacacttgttaactcaggtcaaggcaatactgcagagccacatcgactccaaatgtggacaaatccaccagggcaagatccccgcctgtgtacacaggtcctgggactgcagaatttctggggtcctggcagtggctccttttccctgcattccagaaagccagttcctggaactgcagacagcaagtgacccggacctgcatcacaaagttatgccctggatgccaacggcccttgatcagcagcaacaggctttaccaggtactgtcactgaacaccctaagctgctccgagtcttgtctgtggaagccattgagaaactggagacaactttacggcacaagcatctggccttcctgtcggggctgcctgctctgtattatgtggcgctccccagggccctggccccggcagtcactagccaatctgtcatcacagagatggagcctagtcccgtggaaatcccagcagagcctctgattcagatggtttcatttgaagaacagtgtataagtcttgggccatgccctcaaggcaacaatgagagttgtacagacgttgcaaaagagttccagcctgcagtgccagtaaaaggaacaatggagacgctgcctctagaaagccagacgcatcctactagcccccactcactccagacacatatcttgaccaaactaaacttccacctgagaaaaaaggtcctagagatacaatggggaattcccattagggcaaggaagtccagggaacaaactgttgcagcaccagagaacatatccacacagaagtctcttgaaagtctaaaccaccaaggggagacattgctccaggaactgcccatcccaccagacactcttcctgcccctaatccagaaggggttcaccttaaagaacagctggccaatgacttgaaggcagtgcagcagaaccaaaagcaatccaattccaaagctgtaccccagggttctgcccactcggtctccaagatctcacagcccagtggggacatgacagaggcccacatgccttgtgttcaggtagaggccaatgtgaacaaacccagcctggaggaaccctgtggccctgagcctcaaagccctagcaagagcaaggacccagcccatgtccccatgctagcaggaaacagagaggacccagaggaaaccaaagcagccagggaccacagagaaggggatgcggggtttgggcgctcctcaaccagagaagagagacgccctgctgaagaccagaggccagcagggatgcttccaaacaagacaccccgagggtcctggcgatggagccgtagctttcatcttgctgatccctgtcaacacagcccccagcatcaccctcagcttaagctcccacagctacctccacgagtccctggggagaaagagtctgagaaggacctgcaagacagtcaaaccaagctaactgtcatccttgaaccagcgacaattcctgagaatgcccagactgtgttgccccaggcttcacagggtcagcctttcctgagccaaccaactcaggctaagcctttgcagggccaaactttgcaaggccaagttttgcatgggctggtgatgccagtccatgctcaaaagaagcccagccttacagagtctagcttcagaaataaaattaaatgttttctgcagcatattaaccccaagacaaaaggcaaagggcatgaggactccatgttctcagccgctgcgaaggtggccaaaaccagaaaagaaaatgttgcaaagagcctggctccagccaagagccctgtggggagaagtaagacggagaagccgacagggtgctccaaggcccaatctcgtcctgctcagaagctggtgggcccagccttcttggatggtccccaatccctagacgataagctccggctacactccagacaacctggctctgcctcagccctgggctacccccgccactgccctcgtcactgtcctcgagaggcttgtgccaacaaaccagggcacccaacctagctcctgaccctcacctcagatagaaacattggtccgctcaaggagaacatgcagagccatgaaaaagagtttataggctccccaactgctgcagccctccagaggaccagtattgtcatttccataaatgtgcaggtgggacagatgccactagaaatacactctatatttctcagcaatacattgtctgtctgctccttgtctctgctgtattgtgttaagggaaggtgtgagggaggct

SEQ ID NO: 466301 - DNA, 1157 bp, Homo sapiens
ctggtgacgtcccacagggtggagcctccatctgccaggggctctgagaaccctgagccaccgggaaagccacagtagacatgtagcatgagaaataaaacttcgtcatgctagccactaaaatgatgaggttggctgaacgtgctgcaccctcgcctgcacaaccccatgtacttctcagcaacctctccctcatggacatctgcggcacctcctcctttgtgcctctcatgctagacaatttcctggaaacccagaggaccatttccttccctggctgtgccctgcagatgtacctgaccctggcgctgggatcaacggagtgcctgctgctggctgtgatggcatatgaccgttatgtggctatctgccagccgcttaggtacccagagctcatgagtgggcagacctgcatgcagatggcagcgctgagctgggggacaggctttgccaactcactgctacagtccatccttgtctggcacctccccttctgtggccacgtcatcaactacttctatgagatcttggcagtgctaaaactggcctgtggggacatctccctcaatgcgctggcattaatggtggccacagccgtcctgacactggcccccctcttgctcatctgcctgtcttaccttttcatcctgtctgccatccttagggtaccctctgctgcaggccggtgcaaagccttctccacctgctcagcccaccgcacagtggtggtggttttttatgggacaatctccttcatgtacttcaaacccaaggccaaggatcccaacgtggataagactgtcgcattgttctacggggttgtgacgccctcgctgaaccccatcatttacagcctgaggaatgcagaggtgaaagctgccgtcctaactctgctgagaggaggtttgctctccaggaaagcatcccactgctactgctgccctctgcccctgtcagctggcataggctaggttgtgctgtggtcatgacctcaaaccttgagaggcttaaagccatataaggtttgtttcttgctcctgatgcaggtccaccagaggctggtggggcttctgctccgcatcatggtcttcacccctctgggactcaggaatgacaaaacagctaccattgggaacactgctggtcaccatgacaaa

SEQ ID NO: 466302 - DNA, 4208 bp, Homo sapiens
gatggccttgcatatggtcctccctgcccacctgccatttctcagtcctgaagtgctgaggcttcttgagcccttaaagccctaagtggcccccatccacagtctgggggacaagataatgactcagggagtgatctccagcagaaatacagccagctattctgtgggctcccttctctgcacaatcaatgtcccatttctgactctggctgagtatgaagccttggagtggcacctgctacagaggcaactccagcttcagtggggctggccagctgccctccagaggtctcagcacacccagtgcctcatgcagcatgagccctgtggcaaagctcagtctcctgagaccacgacagcttcccagacagggaagtccatctcagtgctcaccagggaactactcttcttcccggagcatgcccggaagctgctggaattccacatccagaaacagtcgattcgccatcgctggggcctgcctcagaagatccagcagtccatccagttgctccttacctccactgaccagcagactgtgtccagcagcagcacagccctagccaacgtgagcatcccccagcctgtagccctagaggccaacggggcttgcgatgtgctgtcacccattgcggccccagtgtccatccccaggccacacttgttaactcaggtcaaggcaatactgcagagccacatcgactccaaatgtggacaaatccaccagggcaagatccccgcctgtgtacacaggtcctgggactgcagaatttctggggtcctggcagtggctccttttccctgcattccagaaagccagttcctggtactgcagacagcaagtgacccagacctacatcacaaagttatgccctggatgccaacggcccttgatcagcagcaacaggccttaccaggtactgtcactgaacaccctaagctgctccgagtcttgtctgtggaagccattgagaaactggagacaactttacggcacaagcatctggccttcctgtcggggctgcctgctctgtattatgtggcgctccccagggccctggccccggcagtcactagccaatctgtcatcacagagatggagcctagcaacaatgagagttgtacagacgttgcaaaagagttccagcctgcagtgccagtaaaaggaacaatggagacgctgcctctagaaagccagacgcatcctactagcccccactcactccagacacatatcttgaccaaactaaacttccacctgagaaaaaaggtcctagagatacaatggggaattcccattagggcaaggaagtccagggaacaaactgctgcagcaccagagaacatatccacacagaagtctcttgaaagtctaaaccaccaaggggagacattgctccaggaactgcccatcccaccagacactcttcctgcccctaatccagaaggggttcaccttaaagaacagctggccaatgacttgaaggcagtgcagcagaaccaaaagcaatccaattccaaagcagtaccccagggttctgcccactcggtctccaagatctcacaacccagtggggacatgacagaggcccacatgccttgtgttcaggtagaggccagtgtgaacaaccccagcctggaggaaccctgtggccctgagcctcaaagccctagcaagagcaaggacccagcccatgtccccatgctagcaggaaacagagaggacccagaggaaaccaaagcagccagggactacagagaaggggatgcggggtttgggcgctcctcaaccagagaagagagacgccctgctgaagaccagaggccagcagggatgcttccaaacaagacaccccgagggtcctggcgatggagccgtagctttcatcttgctgatccctgtcaacacagcccccagcatcaccctcagtttaagctcccacagctacctccacgagtccctggggagaaagagtctgagaaggacctgcaagacagtcaaaccaagctaactgtcatccttgaaccagcaacaattcctgagaatacccagactgtggtgccccagcttcacagggtcagcctttcctgagccaaccaactcaggctaagcctttgcagggccaaactttgcaatgccaagttttacatgggctggtgatgccagcccatactcaaaagaagcccagccttacagagtctagcttcagaaataaaattaaatgttttctggagtgtattaaccccaagacaaaaggcaaagggcacaaggattccatgttctctgccactgtgaaggtggccaaaaccagaaaagaaaatgttgcaaagagcctggctccagccaagagccctgtggggagaagtaagacagagaagccgacagggtgctccaaggcccaatctcatcgtgctcagaagctgatgggcccagctttcttggatggtccccagtccctagacaataagcttcggttacactccagacaacctggctctgcctcaaccccaggccacccccaccactgtcctcgtcactgtccttgagtggcttgtgccccccaaccagggcacccaccctagctcctaaccctcagttcagatagaaacattggtctgctcaaggagaacacacagagccatgaaaaagagtttataggctccccaactgctgcagccctccagaggaccagtattttcatttccataaatatgctggtggggcagggtgccactagaaatgcactctatatgtttcagcaatacgttgcccatctgctccttatctccactgtattgtgttaagggaaggtgtgagggaggctaaaaagaccttcctgtctagggaaggagctttaacccacaattcagatggttcattttagaggagtgccacagtattccctccttgaggaggtgcttttgtgtttatcaaaacacaatatctaataagacagatgtcagatccagatgatagactctcctctgacttctccctgtttatactgggaagatctttctagaaaatccatcttggagcctgctgtaatcctgctgcctgtttactgcctccactgcctctcagttgcatgaaatgaaagcctcctggaatgagatgacagtagaaaatggagaagggcctgtcccacaggcccagggattggtagggagcagggtcacgtagttggaggtcagagtacctgtgacaaaagttgattctcatgcctgaccaggacatgagaatagagaaaagacagtttgcttggtgctaaaatgagcctagagccaggaggcaaacccaaggcccaagtgctttgggagggatcactgagcttagttctgcttgcccttagtgtgatgaagggcagggtgttgagcactgaagtttctgggaaagaaccacaaatataagaggttttctaaacatatgtgagcctgtcaagttactgccagcagcttgtacccaggcctactgtttctataccacctgtgcctggagcccttctccaccactctccttgccatgatccttactccttaaatttatcttcacagtaactaatggtgggcacccagtcagctgaatcccctcccaggatctacctggtgccttttcctcaggggatgactcctacactttttcctgccaaggacggcaccacagaagcctggcagctccagcccttggttcctgtcacccttctacatctcttcattgtgtcccactgcatttctgaaaacactgaagccaatcaccttggctgtcaaaagaagacaaggcttttggaaagtgtcctattaacacagaaagtgaccacaaatctacaatttaatgccacacatgagtctaacaatgagatcagctgctcataactgaggtggtgggactctggcccttttgcctctctctgggaatgtccaatattttgctattcagggaaatacatagttattattaatgaattctctgaaacctttggaatgaaatgaagtccaagagggaggctgagtggcaagctgagatctacaaggagctgctaagaaatggtgaagagaggcaagaagcaaaagtcacatgaagggtataaactcaagaatttactacttcaggtttgggggtagatgctaggaatacatcagtgcttgcttgggatctttgggttcacctctggcacactcaggtaacaacatgtcatggtgaatgcccc

SEQ ID NO: 466303 - DNA, 2249 bp, Homo sapiens
tccggttccaatcctgcctgttgacatcgaaggccggggactccgagcggatgcatccccgcacctcgctgctcgctgccttctccgagtgtaatcaaacatcaagctaagtagcaaataaatctctcgatctcataagctgcacagcgagatcatgtaaatgcaaatgaaggacctgatttcaagctgtcgagggggaggggagggaacggtggggccctgtcaccgtgaccgcctcacacggcaagggccatacatcagccgccagaacagagcaggcagccggaagggaggccgggctgccccggggagcggggaccaggcaggcggcagagcgcaggcagccccgggccgtgggaaccagacagggctggactgggtggcggggcaggcctgaggacgcctggaggggctccccacggtccgcggctccctttggacccgagctgggagctgctatagcagtcttaacaataagacagcagtaatagaagccatcggttactgagcaacctcctgggccaggagatgattagatcatgaaagcagagcccttgtgatggaatttgtgcccttaaatgaagaggaagaaagctaactctatctctgctctctgccacgtgaagatacaacaagaaggcggccatctgcaaaccaagaagagagccctcaccaagacactggcacccagcctgtgggagctggagagagggggatatagacgagatggcaggagacagcgaggccagagcccaccagaccctctggacagtctttggcgcagccagagtggagagatcccgggaaatgtaacaccctgtgacttcgaaaccaccgcctgtggcctgtggcctgtggcctgtggacagtggaaggagcagctgcacccacccttctcagtaatggccccggggcctgctggcaccagggagccacaagaagctggggctgctgaactcggcaagccccgggaaagaagctacagtctgcccggcattaattttaattatggactctacatccgagggcttgacggaggagtccctgaagccatcggacgctggaacgtgttcaagcagcagcccacctgcccccacgagctgacccggaattatatcgcaatgaaccgcggggcggtgaaagccggcctggtgactgcccgggagaacttgctctaccgtcagctcaatgacatccgcatcagtgaccaggatgaccggcgcatgaagaaagagccgccccctctccctccaaacatgacatttgggatccgggcacgaaaactttccaaacaaatagaaaagttcagaagcaacataactaactcccgtgaacccactacctggatttagcacgctaaccatctggccgctttcgcttctgatcctttcctttaatattgaagaaataaaacgtgtcaaacacaatctgaggcccctgtgcacaccttcctagcctcagcccctccccgtcttccctgaggaccctcccgaggttggagcacgcatgctttccacccagcgtgcccagttttgctctgtcgttagcgatccataaatcatagggactactgagcggggtcctgtgccctggaagtcactctgcacatgactcgctcatctcatgacacacatttgcaacatcaccctgtcccactgtctgaatcgtccgccacaggtgtacccatctctctactgctaaggtgtttctcgtgtccccccatgacaaggcccccaccggcaccctggcacacctggtgcccctgtgcgagggtcctcggggttgatgtccacgagcagagctgctggttggaatgagacctcctctgcctgtgccgacaaccccaattgtccttccgggtgctggccccatctgccctcccatcttctcaactctttctacctcctctgtgtcattgaccacgggtgactgtgaggagatgacccttcccctgtacccctgaccacagatgacagtgaggagatctccctcccgtgtccctgaccatgggtgacagtgagatgacccttcccctgtgtcactgaacacgggtgacagtgaggagatccccccgtcttgtgtccctgaccacaggtgatggtgagatgacccttcacctatatccctgaacacaggtgacagtgaggagatccccctcccctgtgtccctgaccacgggtgacagtgaggagacgccccttccctgtgtcattgaccacgagtgagagtgaggggacgcccccttccct

SEQ ID NO: 466304 - DNA, 913 bp, Homo sapiens
acagcgaatactgctgaacggcaaatgttgctacctgatcgttcctctggaagcttcatctcagatgggtacctggccgttctgcagaggtttctgctgacttttgttcagctatgccctgcccccataggtggagtctacagaggcaggcaggcctccttgatctgtggtgggctccacacagttccagcttcccggccactttgtttacctactcaagcctcagcaatggtgggcgccctacccccagcctcgctgctgccttgcagttcaatctcagaccactgtgccagcaatgtgcaaggctccctgggcatgggaccctctgagccatgtgcgggatataatctcctggtgtgccatttgctaagaccgttggaaaagcgcagtattagggtgggagtgacccagttttccaggtgtctgtcacagctttccttggctaggaaagggaattccctgacaccttgcacttcccagttttgctacttacttcaagactttgggtatgctcacaacattcaagggcttaaatgattagttatgcctagcatggatatgggagggggaattggatgatcagttatgtctgacagcagcatgaaaagggagaatggcaacacgcttactgcactgcatttactgtttctgagctggatagctttgaagagatctttgaaggctaactttatgcagttctgcaaaaatcaacttctccatatttttcaaaagagcttgccacagagacagagctgggagactgctggaccaccataaaccaattgaaagatcatctcttgaaattcaatcctaaatgccattgctggaactcagtagcttctcaataaaagatacacactgaataaatttacatatttaagttcattttccattagctttcctttcaggaaat

SEQ ID NO: 466305 - DNA, 2134 bp, Homo sapiens
ggcccggggcggggctgcggttgcggtgcctgcgcccgcggcggcggaggcgcaggcggtggcgagtggatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagcagataccatcttatgctcacctatgacaagatttggaagaaagtgttgcttaaatttgtgttatttttcactcattatatttctatatatatttggtgttattccatttgctatttaaagaaaccgagtttccatcccagacaagaaatcatggccccttgcttgattctggtttcttgttttacttctcattaaagctaacagaatcctttcatattaagttgtactgtagatgaacttaagttatttaggcgtagaacaaaattattcatatttatactgatctttttccatccagcagtggagtttagtacttaagagtttgtgcccttaaaccagactccctggattaatgctgtgtacccgtgggcaaggtgcctgaattctctatacacctatttcctcatctgtaaaatggcaataatagtaatagtacctaatgtgtagggttgttataagcattgagtaagataaataatataaagcacttagaacagtgcctggaacataaaaacacttaataatagctcatagctaacatttcctatttacatttcttctagaaatagccagtatttgttgagtgcctacatgttagttcctttactagttgctttacatgtattatcttatattctgttttaaagtttcttcacagttacagattttcatgaaattttacttttaataaaagagaagtaaaagtataaagtattcacttttatgttcacagtcttttcctttaggctcatgatggagtatcagaggcatgagtgtgtttaacctaagagccttaatggcttgaatcagaagcactttagtcctgtatctgttcagtgtcagcctttcatacatcattttaaatcccatttgactttaagtaagtcacttaatctctctacatgtcaatttcttcagctataaaatgatggtatttcaataaataaatacattaattaaatgatattatactgactaattgggctgttttaaggctcaataagaaaatttctgtgaaaggtctctagaaaatgtaggttcctatacaaataaaagataacattgtgcttatagcttcggtgtttatcatataaagctattctgagttatttgaagagctcacctacttttttttgtttttagtttgttaaattgttttataggcaatgtttttaatctgttttctttaacttacagtgccatcagctcacacttgcaaacctgtggctgttccgttgtagtaggtagcagtgcagagaaagtaaataaggtagtttattttataatctagcaaatgatttgactctttaagactgatga

SEQ ID NO: 466306 - DNA, 2188 bp, Homo sapiens
ggcccggggcggggctgcggttgcggtgcctgcgcccgcggcggcggaggcgcaggcggtggcgagtggatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagcagataccatcttatgctcacctatgacaagatttggaagaaagaaaataacagactgtctacttagattgttctagggcaacattacgtatttgaactgttgcttaaatttgtgttatttttcactcattatatttctatatatatttggtgttattccatttgctatttaaagaaaccgagtttccatcccagacaagaaatcatggccccttgcttgattctggtttcttgttttacttctcattaaagctaacagaatcctttcatattaagttgtactgtagatgaacttaagttatttaggcgtagaacaaaattattcatatttatactgatctttttccatccagcagtggagtttagtacttaagagtttgtgcccttaaaccagactccctggattaatgctgtgtacccgtgggcaaggtgcctgaattctctatacacctatttcctcatctgtaaaatggcaataatagtaatagtacctaatgtgtagggttgttataagcattgagtaagataaataatataaagcacttagaacagtgcctggaacataaaaacacttaataatagctcatagctaacatttcctatttacatttcttctagaaatagccagtatttgttgagtgcctacatgttagttcctttactagttgctttacatgtattatcttatattctgttttaaagtttcttcacagttacagattttcatgaaattttacttttaataaaagagaagtaaaagtataaagtattcacttttatgttcacagtcttttcctttaggctcatgatggagtatcagaggcatgagtgtgtttaacctaagagccttaatggcttgaatcagaagcactttagtcctgtatctgttcagtgtcagcctttcatacatcattttaaatcccatttgactttaagtaagtcacttaatctctctacatgtcaatttcttcagctataaaatgatggtatttcaataaataaatacattaattaaatgatattatactgactaattgggctgttttaaggctcaataagaaaatttctgtgaaaggtctctagaaaatgtaggttcctatacaaataaaagataacattgtgcttatagcttcggtgtttatcatataaagctattctgagttatttgaagagctcacctacttttttttgtttttagtttgttaaattgttttataggcaatgtttttaatctgttttctttaacttacagtgccatcagctcacacttgcaaacctgtggctgttccgttgtagtaggtagcagtgcagagaaagtaaataaggtagtttattttataatctagcaaatgatttgactctttaagactgatga

SEQ ID NO: 466307 - DNA, 5520 bp, Homo sapiens
tcacctccttctgtggggcatggtgcttcagaggggtcacattccattgggactagtatgtccttggctgctgtccacctacaagacgctccacaacttctttagctcttctgagcttgtggcctgtctatccaactggcacatccctggagaatctgacagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagcagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacagaaccatgtctgtgtcatttctgcctcgactgtagttgttcaccctggcagtgagggtggtggggaggctccagccacctgcgttcctcatggaaagcttcgggttgctcagccaaatcacacacagcaccccaagctggctggcaggagtggacagaagagaccctcgggggctgcaggggtggcagcagcgtttgtcagtcccagccctgaggatgtccttgggaagcctctagaaccttcttttggactcaagggtatggcgtttggctgagtccagtaggcacacacatgtgcaccccagcacggatgcacacccagaagcattcagtcccttgcacggttctagcctaagtctgatgtgattacagctaactaccaggaacagcccttacctgacagaggcactcaaatggtgcaagcccagggagggtgctgagcgcaggggtggggtc

SEQ ID NO: 466308 - DNA, 3458 bp, Homo sapiens
ccgatcctagaggatcccctcgctattcatcggcaccccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagcagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacaga

SEQ ID NO: 466309 - DNA, 2592 bp, Homo sapiens
aggcctgcctggccagggggacaggctggggtgggggcagggtagccccaaaccaggaggggtggacaggctgtggcctacagcttgagggggctggcccttcttttccacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacaga

SEQ ID NO: 466310 - DNA, 4421 bp, Homo sapiens
tcacctccttctgtggggcatggtgcttcagaggggtcacattccattgggactagtatgtccttggctgctgtccacctacaagacgctccacaacttctttagctcttctgagcttgtggcctgtctatccaactggcacatccctggagaatctgacagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagcagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgacaatcaaaaaaaataagaataaaaaaaa

SEQ ID NO: 466311 - DNA, 4016 bp, Homo sapiens
tcacctccttctgtggggcatggtgcttcagaggggtcacattccattgggactagtatgtccttggctgctgtccacctacaagacgctccacaacttctttagctcttctgagcttgtggcctgtctatccaactggcacatccctggagaatctgacagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagcagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggtaaggctcccaggaccttgcactt

SEQ ID NO: 466312 - DNA, 5067 bp, Homo sapiens
tcacctccttctgtggggcatggtgcttcagaggggtcacattccattgggactagtatgtccttggctgctgtccacctacaagacgctccacaacttctttagctcttctgagcttgtggcctgtctatccaactggcacatccctggagaatctgacagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagcagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacaga

SEQ ID NO: 466313 - DNA, 5014 bp, Homo sapiens
tcacctccttctgtggggcatggtgcttcagaggggtcacattccattgggactagtatgtccttggctgctgtccacctacaagacgctccacaacttctttagctcttctgagcttgtggcctgtctatccaactggcacatccctggagaatctgacagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagcagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgatacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacaga

SEQ ID NO: 466314 - DNA, 4436 bp, Homo sapiens
  misc_feature (4375)..(4375): n is a, c, g, or t
  misc_feature (4387)..(4387): n is a, c, g, or t
  misc_feature (4398)..(4398): n is a, c, g, or t
tcacctccttctgtggggcatggtgcttcagaggggtcacattccattgggactagtatgtccttggctgctgtccacctacaagacgctccacaacttctttagctcttctgagcttgtggcctgtctatccaactggcacatccctggagaatctgacagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagcagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttcccgcctgccaggctggcccaggcagtgctcccaccantctatgagcgtntccggggccgnggatctgggcagcatccatggtgccggggccatcccca

SEQ ID NO: 466315 - DNA, 3513 bp, Homo sapiens
tcacctccttctgtggggcatggtgcttcagaggggtcacattccattgggactagtatgtccttggctgctgtccacctacaagacgctccacaacttctttagctcttctgagcttgtggcctgtctatccaactggcacatccctggagaatctgacagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagcagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgttaccattctgatgttggagcggccc

SEQ ID NO: 466316 - DNA, 1083 bp, Homo sapiens
aggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcggtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccaca

SEQ ID NO: 466317 - DNA, 1819 bp, Homo sapiens
aggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcggtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagatttattccctctttatgcttaattaattccttgtgtgtgtgtgttttctcttctttttgactctttctcacacaggggtgggaatacagtgacaatgctatcttacccatagggcatctttcattctgaatacattaaaactaatgcaagctggccagcacttccaaagactcctaatgtaataagcccttgtatttacacagtactttacagattgctaagcaatcttcatatgcagtgtgctacttaatccttatcacaattcaattaggaccttcaatctgagttcttttccagacttcactcactgcagttgtaggaaaaattcttcccttcaccttgaaaatattaactcagtcacttcatcttat

SEQ ID NO: 466318 - DNA, 4498 bp, Homo sapiens
agcgcagaccgcacgggccctccgcgtaccaaggcacacgcatgcgcattggttctgggagccctgaagacctggcggagcccagcgcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattcaaggtagaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactttcaatctaagaaaactatgcgtaaaatatgtctttttttttttttttcttcagagacaggatcccgctctgtctcccaggccggagtgcagtggcacgatcatagctcactgtaacctcaaactcctggactcaagcgatcttcctgccttagccttagcctcctgagtagctaggactgtaggcatgtaccaccgcgcctggcctgtgtctattttatcattcagattaatttaattttgtattttctggctcagatgaacttaaagaagcatcaaacatttcttttttatgaaatgttaaatttaatagcatcacaggccggtaaaatatattcaagtaacagaaatatcaaagtcttttggccacaataaactgaacactttatgaaagcatactcatcatggatcactttgaaatatacgagatctcaacattcaaagtgagaaataaaaagcctttattaaaagtagtgctaggaaacagagaaaataagaataaaatttacccatttgaaatatgtgattttcagactctaaatgaatacagagtttgacagtgtgatgtttacaataatgtcttttctttagaatatctggattatgaaagcaagcacttttttcattaaaaaaattatatactaggaaaaactgtcataatagtattaatgtggggaattttgattatgaaattcagggatatattactgcccgtggtctgtgtcttcaatattgtaagcagcagccatcatgtaatttcagattaataccaattttgttccctgatagatggagcttaaacagtatatgctgctttaaatttctacctctagcagatctttattggagggagttttcctttgtattttttaatgtatgatattctgtttccagtagcttggaaagtagagatgactaatgttttagccttttcttggagaaaaggaagaactcttcttgaatattttcacagatgattgtgattgctttaaatgacctctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatgaaacgatagttgcttggttttcatctaaattaatgtaactatagatgtggggattttaatgagttgagcatatatacttttgaactcttggattagcctatttttatatgcttctaagaagtcagtaacatgaatacttcgccttataatatgccaggccttatactaactattttcactttgtttcattcaagttcactgtaataaagttagaatccattgaggaaaatgaataatcttgattttcagttttgttaaataatggaaaaagaactataaaaggaa

SEQ ID NO: 466319 - DNA, 279 bp, Homo sapiens
actacagcagaattaaggattcagagaaaccaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgatggatacagttgggccactccagtgtgagcctctccatgctgccccatcaa

SEQ ID NO: 466320 - DNA, 4167 bp, Homo sapiens
agcgcagaccgcacgggccctccgcgtaccaaggcacacgcatgcgcattggttctgggagccctgaagacctggcggagcccagcgcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaactgggacaacctgtactctgaaggaagaaagggagagatggaagatgttaggtgttgtggataaggaatgaaataatggaaaacatcacttagatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattcaaggtagaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactttcaatctaagaaaactatgcgtaaaatatgtctttttttttttttttcttcagagacaggatcccgctctgtctcccaggccggagtgcagtggcacgatcatagctcactgtaacctcaaactcctggactcaagcgatcttcctgccttagccttagcctcctgagtagctaggactgtaggcatgtaccaccgcgcctggcctgtgtctattttatcattcagattaatttaattttgtattttctggctcagatgaacttaaagaagcatcaaacatttcttttttatgaaatgttaaatttaatagcatcacaggccggtaaaatatattcaagtaacagaaatatcaaagtcttttggccacaataaactgaacactttatgaaagcatactcatcatggatcactttgaaatatacgagatctcaacattcaaagtgagaaataaaaagcctttattaaaagtagtgctaggaaacagagaaaataagaataaaatttacccatttgaaatatgtgattttcagactctaaatgaatacagagtttgacagtgtgatgtttacaataatgtcttttctttagaatatctggattatgaaagcaagcacttttttcattaaaaaaattatatactaggaaaaactgtcataatagtattaatgtggggaattttgattatgaaattcagggatatattactgcccgtggtctgtgtcttcaatattgtaagcagcagccatcatgtaatttcagattaataccaattttgttccctgatagatggagcttaaacagtatatgctgctttaaatttctacctctagcagatctttattggagggagttttcctttgtattttttaatgtatgatattctgtttccagtagcttggaaagtagagatgactaatgttttagccttttcttggagaaaaggaagaactcttcttgaatattttcacagatgattgtgattgctttaaatgacctctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatga

SEQ ID NO: 466321 - DNA, 3797 bp, Homo sapiens
actatgttctgaggctgcagttggaatcagacagacatgacctcctacgcagcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattcaaggtagaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactttcaatctaagaaaactatgcgtaaaatatgtctttttttttttttttcttcagagacaggatcccgctctgtctcccaggccggagtgcagtggcacgatcatagctcactgtaacctcaaactcctggactcaagcgatcttcctgccttagccttagcctcctgagtagctaggactgtaggcatgtaccaccgcgcctggcctgtgtctattttatcattcagattaatttaattttgtattttctggctcagatgaacttaaagaagcatcaaacatttcttttttatgaaatgttaaatttaatagcatcacaggccggtaaaatatattcaagtaacagaaatatcaaagtcttttggccacaataaactgaacactttatgaaagcatactcatcatggatcactttgaaatatacgagatctcaacattcaaagtgagaaataaaaagcctttattaaaagtagtgctaggaaacagagaaaataagaataaaatttacccatttgaaatatgtgattttcagactctaaatgaatacagagtttgacagtgtgatgtttacaataatgtcttttctttagaatatctggattatgaaagcaagcacttttttcattaaaaaaattatatactaggaaaaactgtcataatagtattaatgtggggaattttgattatgaaattcagggatatattactgcccgtggtctgtgtcttcaatattgtaagcagcagccatcatgtaatttcagattaataccaattttgttccctgatagatggagcttaaacagtatatgctgctttaaatttctacctctagcagatctttattggagggagttttcctttgtattttttaatgtatgatattctgtttccagtagcttggaaagtagagatgactaatgttttagccttttcttggagaaaaggaagaactcttcttgaatattttcacagatgattgtgattgctttaaatgacctctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatga

SEQ ID NO: 466322 - DNA, 1810 bp, Homo sapiens
gcaataaactacacggcgtatggtagcgaggcgggtggcgccatttgaaatatgtgattttcagactctaaatgaatacagagtttgacagtgtgatgtttacaataatgtcttttctttagaatatctggattatgaaagcaagcacttttttcattaaaaaaattatatactaggaaaaactgtcataatagtattaatgtggggaattttgattatgaaattcagggatatattactgcccgtggtctgtgtcttcaatattgtaagcagcagccatcatgtaatttcagattaataccaattttgttccctgatagatggagcttaaacagtatatgctgctttaaatttctacctctagcagatctttattggagggagttttcctttgtattttttaatgtatgatattctgtttccagtagcttggaaagtagagatgactaatgttttagccttttcttggagaaaaggaagaactcttcttgaatattttcacagatgattgtgattgctttaaatgacctctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatga

SEQ ID NO: 466323 - DNA, 618 bp, Homo sapiens
gtcattcatttctcagttggcaactggtgcctgcagtctttctgaaacctgccagaattggtggttaacactagtttaaatttgaatgactattattttgttttaagtgattttaaatgaaggctagaagttgaatagaggataaacaaaactctaacaaataccatttggtaataatatgtagagattagattataatattagtgttattggggatgatttccaaattgattacttaatcagattattgatatcagtatttcccataaatgactgtttggttactgtaattataatgttgatcagaagtttagcttctgtatctctgtcaaatattaatactctgtaaaaggtaactggcagatttaaataattaattaaaagaaaaaagcaaaataacataacagatgcagtaatttgatttttcttcattagatacctgggactgtattgctacctgtttcttcatagacacagctcacaatgtaattgattatattgatacaatatggaaaatactcaagccaggtggaatttggataaatctaggtaagttttttagtatttactaaaattttgtatattaatctgagtacttacagctgtattacatttaac

SEQ ID NO: 466324 - DNA, 4214 bp, Homo sapiens
agcgcagaccgcacgggccctccgcgtaccaaggcacacgcatgcgcattggttctgggagccctgaagacctggcggagcccagcgcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattcaaggtagaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactttcaatctaagaaaactatgcgtaaaatatgtctttttttttttttttcttcagagacaggatcccgctctgtctcccaggccggagtgcagtggcacgatcatagctcactgtaacctcaaactcctggactcaagcgatcttcctgccttagccttagcctcctgagtagctaggactgtaggcatgtaccaccgcgcctggcctgtgtctattttatcattcagattaatttaattttgtattttctggctcagatgaacttaaagaagcatcaaacatttcttttttatgaaatgttaaatttaatagcatcacaggccggtaaaatatattcaagtaacagaaatatcaaagtcttttggccacaataaactgaacactttatgaaagcatactcatcatggatcactttgaaatatacgagatctcaacattcaaagtgagaaataaaaagcctttattaaaagtagtgctaggaaacagagaaaataagaataaaatttacccatttgaaatatgtgattttcagactctaaatgaatacagagtttgacagtgtgatgtttacaataatgtcttttctttagaatatctggattatgaaagcaagcacttttttcattaaaaaaattatatactaggaaaaactgtcataatagtattaatgtggggaattttgattatgaaattcagggatatattactgcccgtggtctgtgtcttcaatattgtaagcagcagccatcatgtaatttcagattaataccaattttgttccctgatagatggagcttaaacagtatatgctgctttaaatttctacctctagcagatctttattggagggagttttcctttgtattttttaatgtatgatattctgtttccagtagcttggaaagtagagatgactaatgttttagccttttcttggagaaaaggaagaactcttcttgaatattttcacagatgattgtgattgctttaaatgacctctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatga

SEQ ID NO: 466325 - DNA, 3873 bp, Homo sapiens
agcgcagaccgcacgggccctccgcgtaccaaggcacacgcatgcgcattggttctgggagccctgaagacctggcggagcccagcgcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattcaaggtagaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactttcaatctaagaaaactatgcgtaaaatatgtctttttttttttttttcttcagagacaggatcccgctctgtctcccaggccggagtgcagtggcacgatcatagctcactgtaacctcaaactcctggactcaagcgatcttcctgccttagccttagcctcctgagtagctaggactgtaggcatgtaccaccgcgcctggcctgtgtctattttatcattcagattaatttaattttgtattttctggctcagatgaacttaaagaagcatcaaacatttcttttttatgaaatgttaaatttaatagcatcacaggccggtaaaatatattcaagtaacagaaatatcaaagtcttttggccacaataaactgaacactttatgaaagcatactcatcatggatcactttgaaatatacgagatctcaacattcaaagtgagaaataaaaagcctttattaaaagtagtgctaggaaacagagaaaataagaataaaatttacccatttgaaatatgtgattttcagactctaaatgaatacagagtttgacagtgtgatgtttacaataatgtcttttctttagaatatctggattatgaaagcaagcacttttttcattaaaaaaattatatactaggaaaaactgtcataatagtattaatgtggggaattttgattatgaaattcagggatatattactgcccgtggtctgtgtcttcaatattgtaagcagcagccatcatgtaatttcagattaataccaattttgttccctgatagatggagcttaaacagtatatgctgctttaaatttctacctctagcagatctttattggagggagttttcctttgtattttttaatgtatgatattctgtttccagtagcttggaaagtagagatgactaatgttttagccttttcttggagaaaaggaagaactcttcttgaatattttcacagatgattgtgattgctttaaatgacctctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttggggaatggccctggcctatggttttttg

SEQ ID NO: 466326 - DNA, 943 bp, Homo sapiens
tcaaagagcataaactttcagttacaagatgaaggattcctgtgctttaagagttttaaaccataatttacttcccaggttaaaggtgacacatatcgttttttggcctttattattttgtgccagaaataatgaattcaatttcatggataagaaaaggccaggtcactcatatgtatcctgtctttcttttctgatctccctagtcttgtttaagctaagtggcttctggactgttacccctaaacctttctcacttccaatacctagccctcctaaagatcaggtcttcttcaaggggttcttgattcttgaatcctctatgcaccctaagtccattgtggtaattatggggatagtgggagtggaacaagggacttcagcagaagcagatgccggcactatgcttcttgtacagcctgcagaaccatttacctttttcagcggttgatttttctggaggttttattcacttggattcatattgattggaagaatgcatgagaccagatttgttagtagtactgacacagtggttgctgttggcttcctggtgatgaaaatgagcttctttgcagctgctctgagagctcccagtcttattgatgagaaatagtaccagaaagcaactagctggggacctgtaccattagggtccaggcaggaaacagaaaccactgcaatcattttaacagaaagaatttaatataaacaattgcaaagggtatcgaagaattgaaagataaacagaactaaagtattagagaagggagcaacagtaggaattaactaccagctcctgggttgggaaacaaagcccaatgcatttggcagaaaattcagatgtgttgattggccatgttctatagcaacgacaaaaacttcagttaaaaaatgcatcatttgcctgcactgacattccttccagcagatgacatttcag

SEQ ID NO: 466327 - DNA, 957 bp, Homo sapiens
tcaaagagcataaactttcagttacaagatgaaggattcctgtgctttaagagttttaaaccataatttacttcccaggttaaaggtgacacatatcgttttttggcctttattattttgtgccagaaataatgaattcaatttcatggataagaaaaggccaggtcactcatatgtatcctgtctttcttttctgatctccctagtcttgtttaagctaagtggcttctggactgttacccctaaacctttctcacttccaatacctagccctcctaaagatcaggtcttcttcaaggggttcttgattcttgaatcctctatgcaccctaagtccattgtggtaattatggggatagtgggagtggaacaagggacttcagcagaagcagatgccggcactatgcttcttgtacagcctgcagaaccatttacctttttcagcggttgatttttctggaggttttattcacttggattcatattgattggaagaatgcatgagaccagatttgttagtagtactgacacagtggttgctgttggcttcctggtgatgaaaatgagcttctttgcagctgctctgagagctcccagtcttattgatgagaaatagtaccagaaagcaactagctggggacctgtaccattagggtccaggcaggaaacagaaaccactgcaatcattttaacagaaagaatttaatataaacaattgcaaagggtatcgaagaattgaaagataaacagaactaaagtattagagaagggagcaacagtaggaattaactaccagctcctgggttgggaaacaaaggtaaataatggaattatcacaatttagaagtttggaggagggtatctctggggttgggacccatgaatttgagggggtggggacagacaattggtccagatatttcttagtgaatgtgatgggactggtctgcatgtgtt

SEQ ID NO: 466328 - DNA, 1442 bp, Homo sapiens
  misc_feature (3)..(5): n is a, c, g, or t
  misc_feature (11)..(12): n is a, c, g, or t
  misc_feature (14)..(14): n is a, c, g, or t
ccnnntctctnncngggatgcctcagggctgcctggcacatgccaagcccagtgtgctgtcatctttctccagagaagcgcccagtcccattgaccacccaagggctgaggagtgcgggcgcacagcacaggactggcaggcagctccacctgtggccctggtgtgggatccactgggtgaagccagctgggctcctaagtctagtggggacttggagaacctttatgtctgcagcttcactcctgaagccatcgagaccatgaacccaccgggaggaatgaacaactccagacgcaccaccttaagagctgtaacactgaccgcgaaggtctgcagcttcactcctgagccagtgagaccacgaacccaccagaaggaagaaactctgaacacgtccgaacatcagaacgaacaaactccagacacactgcctttaagaactgtaacactcaccacgagggtccgcagcttcattcttgacgtcagtgagaccaagaacccaccaattccggacacaaagggatgagtcataccactgtctcctcacaccggacatgggatagccacagcagaagccactttatggcccagagaaattccagggaaaaaggattgtattaattgataacatcatcagcaatgcatgaaagcacacatctcctcatacctggtcattacaggataatctttactaactgattagtgggtagcatgttgttatttgttttgggattggtacacttgagccttttccaagcttccatggttgtatattctcttatttggagtggtctgttcatgtcctatggtcactgatttgtaggagatctttatgccaaagttactgatctttcttcactgcaaatacttgttccagtcattacttttttattggaaagcgtcagattatacacagaaattccaggcagactaaaatgttttccaaaataatagaaaatttgaagagaaccaagtttcaaattcttaatagctgttagaagaaacaattttaaaagaaatatatacgtattttttgtgacaaggtctctctctgttgtccaggctagatagtatgatcacagcacactagtcttgaactcccaatcaatcctcccaccttagcctcccacgtatctgggactacaggcgcaagccacaacacccactacttgggaggcagaggcaggagaattgcttgaacctgggaggtggagattgcagtgagctgagattgtgccattgcacttcagcctggggaacaagagcaagactttgtctcaaaaaaaaaaaaaaaagtatgcttaaaacagaacaaataattctgaatacaaatttttaattatgaataaactagattcatcttcatcatagtaatatggcaatggatactggactcttgaaccaggagtaaaaaaatgaaaaaaaaaaccccttcaaatat

SEQ ID NO: 466329 - DNA, 1489 bp, Homo sapiens
  misc_feature (3)..(5): n is a, c, g, or t
  misc_feature (11)..(12): n is a, c, g, or t
  misc_feature (14)..(14): n is a, c, g, or t
ccnnntctctnncngggatgcctcagggctgcctggcacatgccaagcccagtgtgctgtcatctttctccagagaagcgcccagtcccattgaccacccaagggctgaggagtgcgggcgcacagcacaggactggcaggcagctccacctgtggccctggtgtgggatccactgggtgaagccagctgggctcctaagtctagtggggacttggagaacctttatgtctgcagcttcactcctgaagccatcgagaccatgaacccaccgggaggaatgaacaactccagacgcaccaccttaagagctgtaacactgaccgcgaaggtctgcagcttcactcctgagccagtgagaccacgaacccaccagaaggaagaaactctgaacacgtccgaacatcagaacgaacaaactccagacacactgcctttaagaactgtaacactcaccacgagggtccgcagcttcattcttgacgtcagtgagaccaagaacccaccaattccggacacaaagggatgagtcataccactgtctcctcacaccggacatgggatagccacagcagaagccactttatggcccagagaaattccagggaaaaaggattgtattaattgataacatcatcagcaatgcatgaaagcacacatctcctcatacctggtcattacaggataatctttactaactgattagtgggtagcatgttgttatttgttttgggattggtacacttgagccttttccaagcttccatggttgtatattctcttatttggagtggtctgttcatgtcctatggtcactgatttgtaggagatctttatgccaaagttactgatctttcttcactgcaaatacttgttccagtcattacttttttattggaaagcgtcagattatacacagaaattccaggcagactaaaatgttttccaaaataatagaaaatttgaagagaaccaagtttcaaattcttaatagctgttagaagaaacaattttaaaagaaatatatacgtattttttgtgacaaggtctctctctgttgtccaggctagatagtatgatcacagcacactagtcttgaactcccaatcaatcctcccaccttagcctcccacgtatctgggactacaggcgcaagccacaacacccagccaattttttttttgtagagacgggttttcgccatgctggtctcaaagtcctgggctcaagcgatccacccacttcagcctcccaaagtgctgggattacagtgagctgagattgtgccattgcacttcagcctggggaacaagagcaagactttgtctcaaaaaaaaaaaaaaaagtatgcttaaaacagaacaaataattctgaatacaaatttttaattatgaataaactagattcatcttcatcatagtaatatggcaatggatactggactcttgaaccaggagtaaaaaaatgaaaaaaaaaaccccttcaaatat

SEQ ID NO: 466330 - DNA, 853 bp, Homo sapiens
gcgagaagttgatggtctcgttactttatcttatcttgcccttttcgggcatttgggctctgaattggagcagatggagaggacaagaacttgaaatgaaaagcacaagctttcaacatagtggccttttattttctgcgcttttggagtgtgagaacaccatagaggctacacgcaccacggcgtttctgtgggctgggaatcaaggcctggagaagggggtgggcagccgggaagtgacagtgcagggagggggagttggcagctgtcaaatgaatgcatttccctcttctattatcctgctatccgaatgctccatctattcatattcatggtttccatcactgtgcatagcaccaaggccagcttccttttcacatttcatcttcttgtctttcttggagtttcattttgatttactaaaaatcagtggactgcttctaaacaaggatcagctaatagaaactggaggtagttggtagagaatctactgggaggaatttatttacatacaagaagttaaagccaaatgtatgtgctccattcatttaattaattaatttatttatttatttatctatttatttatttattttggagacagggtctcactctgtcaccaggctggagtgtggtggtacaatcatggcttactgcagccttgacttccagggctcaagtgatccttctgcctcagcctgctgaatagctgagactgtaggtgtatgccactgtgcccagctgatttttaaaaatcacttgtagagacaaggtctcaccagcctggccaaaatggtgaaaccccgtctctattaaaaatgcaaaaattagccaggtttggtggtgcgtgcct

SEQ ID NO: 466331 - DNA, 1337 bp, Homo sapiens
cccagagggttgggaaactcactccacagataaccctcttgatatagtcaattagatgaggttgatggcaatatgttttcctcatgttttaggacaagactccctcacacatggcacttctcacacctagcccaaagcaagaaatttgctgggtggaaagcaccccaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagatgactctcttaatccagtgctgtacattctagaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggaacaagatctagaacctgaaaaagtcaaatcaggttgtctaaatgagatgtgggaaccgcagaaatgtgaatccccgcagaaaactgaatccactgtgtgtgggtataacccagaattaatgctactttaccctgtaacgcttcagtgtgtggctcctttgcctctgtttgtttacaggtagaattggaggtatacgacttcttctttgaaaggagtgcacct

SEQ ID NO: 466332 - DNA, 1623 bp, Homo sapiens
aatactgctggcttttattttaaaaggtattgagatacaaaaattgtatcttatcttgtaaaaaatatttatttatcaatctttctggcactattaaaaatgtcccattttcactagacagaatcacaaaggtatacccactcaatcataacaatttgttttctatggagcaatattcacagatcctgtgaataaataggtgacaaactccaggtggccccctgtagggtctgttatatttaaagttttctggaacacacataattatgaggtttggctctcctacagtcttttgtttgccatttcccttgtctttgaaccaaaacacagctctttccaagcttggagcgtggagagggccctcttctcccattggtgaaggcaacaggttcaccaccgatccactcccagtggccagcatgcacttgacttcgttgggaacctcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagatgactctcttaatccagtgctgtacattctagaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggaacaagatctagaacctgaaaaagtcaaatcaggttgtctaaatgagatgtgggaaccgcagaaatgtgaatccccgcagaaaactgaatccactgtgtgtgggtataacccagaattaatgctactttaccctgtaacgcttcagtgtgtggctcctttgcctctgtttgtttacaggtagaattggaggtatacgacttcttctttgaaaggagtgcacct

SEQ ID NO: 466333 - DNA, 759 bp, Homo sapiens
tgtcatcttgtctccccacatcatcttgtctccccatgtcatcgtgtctcccagtgtccagtagggcagagggggaggcccagaggcaggatgaaaaaccacagtctgagagcttgtagagagtgcccgagaggcctggaggagacttgggacctgctttcacaactgcagaggagaattgggcggtcaggatgtggggtggtggaggggctgtggccctaacgcccactctgccctccaaacccacctgcttctggctgcagcttgtgcctcctggctcctgcagcctcctggggacacaccttgacaaaggtgactttggtcagctctctggtccagaacccccaggtgaggtgggcaaaagagcacctgatggagcctcccggtcctctcttgagcctatggaagatgctgctcccattatctacctgttagcttccccagatcctcgaatcaagcatcctcaggatctggcctccaccccatcaccaggcccaatgaccacctcagtctcctccctaagtgcctcccagccaccagaaccttcccttctcctagaacgcccctcacccaagccacctgcacttttcctcacccaccacacacccctgatcctctggcctgctctcctcctcctccaaaagacttcactgctcctcccctgtgggactccactctgataactccatttcactgtgactcagtggcacttccactgggcaccgtccctcaaagcttgtctccacatgaggatttggc

SEQ ID NO: 466334 - DNA, 872 bp, Homo sapiens
ggaagcaacataagcgcccatcaattaatcatttttctggaaaaccgatgtgggggcaatgactgctcacctgttcatgccccatccttgtgctggtttcagaacccaaggacccgggagtgacccagggtgtgggaggaaggatgccttaaaaagaggaaaagggaggaccaaggggaggctggaggctccaaagagaaagttacattataatcttgcctggactaacctgagatattatgtattcatcaccactccatttttattttatttgaaatttgaatgtttaaaaatattaattatatatttttcatatctgcttcagaaaaaaaaagtcaaagaaaaactaaggccttcctttcctatcacccatcaatgttggcagagatggaaaaaacaggtattcttaaatattcttggagggaatgtgaattaaaatagtagttttgggagatgttttaaaattttctataataagcatatttctaattagtatatattactttcacaatagaaaaaataaactggatcaaagctatactcaacttcaagatgactgttcactgagaaatgtgaaattaatatgaaatatgaaagaaaactcttactatgtaaatgaatcacagaatccaagaaagatgtgccggatgggaactagaggtcatctagattgcattctgtctaatcagatcatatgaaggagccaaagctgtcttcctgttagctccagagtaaaagtagcctgcagcccacaccctggggtctgatgaaaggactcacactccagtctgcattcctgctgcacctgccagaccctgctgacaaaatttctgtttctccattgaccaaataaaactgcagtgtggcccctt

SEQ ID NO: 466335 - DNA, 905 bp, Homo sapiens
aaaccattcatgaataatcatccccatgatccaatcacctcccaccaggccccacctccaacactggggattacaattcaacatgagattcaactcacaggatgcacaacaccaacggtgaacccaaatgtgaactatggacttggggcgataatgatgcatcagtgtaggttcatccattgtggagaatgcagcaatctggagctggctgcagcataccatgaatcctcacagcaacttaatgaggaaagttttgataactttggaacagacatctccatttctcttgatgggtacctaaatggagatttagatgagactgtcagcagccctctgggtcctcactgctcgcagtgtccacaggcagcagcagcagaatctgggagtttattagatatgtaggatggcagatccactgcaggcctcctgagtcagaatctgtcctttaagaagatccccagaccaataggaattaaatccaagaaggaaggctttgtaaaatatggtgcaggtcaaccacaaacatttcaaagggcaccaccattgagacaacatggaagtggaggaaacaattgaacaacattagagtcaagtgagagttgactgtgaagggcatggggagtttcacagtgactcctgggttttgagcttttgtgaagataacaaaagatgcctcttgattttaatttttctaatcagccttcccaaatttattatggaaaattactttaagtgtttatactttccacctcttctctgtatgatctgtataaaataaaattactttacatgacattgtaccctgtctgccttcctccttatttgtcccagtgcccttgtaaggagagaagcactggactgtagaaaaatgaaatatctgatggtaagcatcattctaaagacaa

SEQ ID NO: 466336 - DNA, 2329 bp, Homo sapiens
ggtcctcagtggactggacgatgccacactgggtcatatagtatgctggctgttgtgtctggcttctcctatggaacagtttacagagtccatccacgtgatagcttttcatggctgggagctgaggactacgaggcatcacaaaagtggccacgagaggcaggtaaaggcccccaaagtcttcaccatcgtccgcctcagaaaatcacttgtctgatgctcaggcggagcccagcaaacaccccgaccccctggaggtgccacgaggaaaggagtgtcctcagagagcttccggggaagccagccctatgaagccctccacgttcaccaggagttcatcgcagctgcggccaggctgggaaggagaggtggccacaggcaggcagcgtgtctgttccggatgcaaagcgcagccccagccccgcccgctggagccctctctggcgctgggtggacaaagctgcagtgcgccggccagggaaggccgaggagccgcccaggcgaggcccgagctgcctggtggcatctgtgtggaccccaggccatgtcactgcctcagcacactcgacctccaactcacattcctcacaggtggcccgggaaaggggaccacccactcggcaggagctccctgagccagctcagtggatggagcaaactgacttggaaatcaaagtgatgcccagacggagcaagagacagccccggaccagcccccgggccacacccgcgcaccagccaggaccaggccccgcggaggcttgctgggaagctggcgctgtgttgtttcccccgccagctgctcgcttcctcccgggctcactggagtgcaaactgctttcacttgtttgaaatggaaattttttcgtctctttatacttattgtcacttgtatttttctccccagaaatggggatttggacgtgaaggcggcttgtgtgtgcgtttccgtgtgcgtgaacagacacatctgtttccactttgggttgggggggttggcgcagggcgagggctgcagtctgagccaacagagtctacggaagcagagacagaagcctgtggagggggcagggcgtgggcagaagcagcccctgcgggtggggctgaggccagggttcctctccaccagccccttacggctgcgtcaggtgtgggggtcctggggacatctgctccttcccatggctttggaggctgccagagcctgccccagccaccccccgggtcctggctgtcactgagccctccgtctccctgcctttgcacccaagttcccccaacccctttatctgggtccctaggaacgcccttatccttccaggcccagctccagttggcttcacccctccagaagccaccctgccagtctttgctctagctcgggtgcctcggggtttactgcagacctggccatgtgtttggggtgagcacagacttcagagtccagcagcgtcaggccacctcgtgccctgcccttctccccgcgtgctacctccaaggcctggctcacacaggtgctttgtggggggagtggagatgaagacaaaggtaaccacaaggatagtcccccctccaggagccccagcctgcactgcaaggacaaggcggtggaacgacctgcagcagagaccagggcctgggactgccggggtggtgagggtgtgcttcccagaggtggctgggcctgagccgcagggactgaagggatcaggcagggctacctggaagaagttgcatccaaaaagagacaccaaggatgggaggagctatgcagatgacaagaaggaggaggaggaggaggaagagaggaaaagcaggcaggtggatgaagagagccggtcccttccaaaggggcagagcacagagtggtcagggtgggcagaggaggaactggggctctgtcctctgggcagcgacatctctgtgtgccaggcctgggtggagggagctctggagacgtcacgcagcccctacagcctgcagggtacagaccagggccatcttccagcagctctgaagagccagtgccgctgcccagagcctggtgttgaagaggatgctgaagtgcactccagctctgcaggaggcaccgctgagagacacggccacggtgggagtgtggagtggacacagcagaacatgcgtctctggtccacgggcaggggtttgaacatgaacagcgggttgccggcatgcataacttaattgcaataattaatgcatggatacctgctggatgacagggcacctgtggagtgccagcctgtatgctggcacctgatgtgcttatggaatttcattccatttctttttgagaccgagtcatgtg

SEQ ID NO: 466337 - DNA, 2290 bp, Homo sapiens
acaacggccatccctgtggctgggccgccggctacgcaatgctgtctctcttgctgatcctctcaggcctgggcgctgacctccgcgggcccacgccacttattccatcaaaattgaggggaaaccataccttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagaggattactgcagttagataatatcagttatggtattgaaccattggaatcttcacctacatataagcatgtagtttatcgaattaaaaatgatgctattggtcattcctcctttcaagaaaattatcctgtggctcaatatatagatcagtcctacaggattcttgtcaaatcagacataaattcaggtgccatgctatcgaaaagaactctgaaaatacaaatcattatggataaagccatgtatgcttatatgggctccacggtggcagttgcagttgagaaagttttccaaatctttggtcttatcaacactatgttttcccagcttaatatgacagttatgctgtcttccttggagatctggtcagatcaaaataagatttcaacaagtggtcatgctgatgaaatactacagcgatttttgccttggaaagaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatatgatcccatggtatgaagttttttagcagttgcagcatggatggatttaaacggatagttctgcagcctgaacttaaatgttttcaggataaaacagtttcaaaaatgacttaccgaaaatcttcaacttgtggcaatggaattttggaacctacagagcagtgtgattgtggctataaagaggcatgcactcataaaaaatgctgtaatcctgcagattgtactctagttagatctgcagaatgtggcactggatcatgctgtaacaataaaacttgtacgatccacgaaagaggccatgtctgcagaaaaagtgtagatatgtgtgattttccagaatattgcaatggaacatctgagttttgtgtacctgatgtgaaagctgctgatttagaatactgcagtaataagactagctattgctttaaaggagtatgcagagaaagggatagacagtgttcacagttatttggaaaatttgctaagtctgctaatcttctgtgcacagaagaagtgaattttcaaaatgacaaatttggaaactgtggttcccgttgtgatttttttgatatcctttgtggaaagattgtttgtcactggatacattcagaactagtaccaatgacagacttagacatacaatatacttaccttagaggtcacgtatgtttgtccgcacatgcaagaaatggttcaaaacaatcggagacctatacagaagatataactgcatgtggccaacacaaggtatgtcactcccgagaatgcagaaattttagtgaactaaatataacaaaatatactacaaattgtggacagaatgggatttgcaatgaacatttccattgtcaatgtgatcctggttatgctcctccagattgtgagccagcaatgtcatcaccaggaggaagtatcaatgatggattttggcttacagtagaaaaaagtgtacccttgcttccaaaacgacgtgctgctcctaaaaacaatggtcttttgatcagtttctacattttttcacctttgctcattttaattgctattgttagtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 466338 - DNA, 2368 bp, Homo sapiens
  misc_feature (1191)..(1191): n is a, c, g, or t
  misc_feature (1268)..(1268): n is a, c, g, or t
acaacggccatccctgtggctgggccgccggctacgcaatgctgtctctcttgctgatcctctcaggcctgggcgctgacctccgcgggcccacgccacttattccatcaaaattgaggggaaaccataccttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagaggattactgcagttagataatatcagttatggtattgaaccattggaatcttcacctacatataagcatgtagtttatcgaattaaaaatgatgctattggtcattcctcctttcaagaaaattatcctgtggctcaatatatagatcagtcctacaggattcttgtcaaatcagacataaattcaggtgccatgctatcgaaaagaactctgaaaatacaaatcattatggataaagccatgtatgcttatatgggctccacggtggcagttgcagttgagaaagttttccaaatctttggtcttatcaacactatgttttcccagcttaatatgacagttatgctgtcttccttggagatctggtcagatcaaaataagatttcaacaagtggtcatgctgatgaaatactacagcgatttttgccttggaaagaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatatgatcccatggtatgaagttttttagcagttgcagcatggatggatttaaacggatagttctgcagcctgaacttaaatgttttcaggataaaacagtttcaaaaatgacttaccgaaaatcttcaacttgtggcaatggaattttggaacctacagagcagtgtgattgtggctataaagagngacaggatttcaccatgttggccaggctagtctcaaacttcggacctcaggttatccacctgcctcagcctctcaangcatgcactcataaaaaatgctgtaatcctgcagattgtactctagttagatctgcagaatgtggcactggatcatgctgtaacaataaaacttgtacgatccacgaaagaggccatgtctgcagaaaaagtgtagatatgtgtgattttccagaatattgcaatggaacatctgagttttgtgtacctgatgtgaaagctgctgatttagaatactgcagtaataagactagctattgctttaaaggagtatgcagagaaagggatagacagtgttcacagttatttggaaaatttgctaagtctgctaatcttctgtgcacagaagaagtgaattttcaaaatgacaaatttggaaactgtggttcccgttgtgatttttttgatatcctttgtggaaagattgtttgtcactggatacattcagaactagtaccaatgacagacttagacatacaatatacttaccttagaggtcacgtatgtttgtccgcacatgcaagaaatggttcaaaacaatcggagacctatacagaagatataactgcatgtggccaacacaaggtatgtcactcccgagaatgcagaaattttagtgaactaaatataacaaaatatactacaaattgtggacagaatgggatttgcaatgaacatttccattgtcaatgtgatcctggttatgctcctccagattgtgagccagcaatgtcatcaccaggaggaagtatcaatgatggattttggcttacagtagaaaaaagtgtacccttgcttccaaaacgacgtgctgctcctaaaaacaatggtcttttgatcagtttctacattttttcacctttgctcattttaattgctattgttagtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 466339 - DNA, 1916 bp, Homo sapiens
  misc_feature (796)..(796): n is a, c, g, or t
  misc_feature (873)..(873): n is a, c, g, or t
acaacggccatccctgtggctgggccgccggctacgcaatgctgtctctcttgctgatcctctcaggcctgggcgctgacctccgcgggcccacgccacttattccatcaaaattgaggggaaaccataccttcctgcttgaaaaacaggtcattgcttttaccaaggatatgctgcagacattccaaaatcagttgtggcactacgcacctgttctggactcagatgttttcccagcttaatatgacagttatgctgtcttccttggagatctggtcagatcaaaataagatttcaacaagtggtcatgctgatgaaatactacagcgatttttgccttggaaagaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatatgatcccatggtatgaagttttttagcagttgcagcatggatggatttaaacggatagttctgcagcctgaacttaaatgttttcaggataaaacagtttcaaaaatgacttaccgaaaatcttcaacttgtggcaatggaattttggaacctacagagcagtgtgattgtggctataaagagngacaggatttcaccatgttggccaggctagtctcaaacttcggacctcaggttatccacctgcctcagcctctcaanttcaaaatggggcataaagcagcggaaacagtcaacatcaacagtgcatttggcccaggaactgctaacaaacatacgcacagtggtggctcaagatttgcagaggacaggagaaacttgcagaggagcatagtggccaccattggaaatcaaattgccacatgcaaggaaaagtggattgtatgtgacaattggcaacaacctgctcagtgtctgatccactacaactttctgaatcccggcaaaaccattaaatctgagaagtatgctcagcaaatcgatgagctgcacaaaacctgcaacgcctgcagccggcgttggtcaacagaaagggcccgagtcttctccatgacaacaccaggccacacatcgcacaaccaacacttcaaaaaagaggccaagggacagcttgggctgttgcttcagagggtagaagccccaagccttggcagctgccacatggtgtggagcctgcaggtgcacagaagtcaagaattgaggtttgggagcctctgcaaagatttcagaagatgtatggaaatgcctggatgttcaggcagaagtttgttgcaggggcagggctctcatggagaacctcttcttgggcagtgtggaagggacatgtggggttggagcccccacagagtccctactgggacactgcttagtggagctgagagtagacagccacaatcctccagaccccagaatggtagatccaccaacggcttgcaccgtgtgactggaaaagctgcagacactcaacaccagccagtgaaagcagtcaggaagaaggctgtatcctgcaatgccacaggggtggagctgcccaagaccatgggaacctacctcttgcatcagcatgacacgagtttgatacatggagtcaaagaaaatcattttggatctttaagatttgactactctgctggattttggacttgcatggggcttgtatcccctttgttttggccaatttctcccattggaatgtctgtatttacccaatgcctgtacccccattgtatctagaaagtaactaa

SEQ ID NO: 466340 - DNA, 2635 bp, Homo sapiens
  misc_feature (1191)..(1191): n is a, c, g, or t
  misc_feature (1268)..(1268): n is a, c, g, or t
acaacggccatccctgtggctgggccgccggctacgcaatgctgtctctcttgctgatcctctcaggcctgggcgctgacctccgcgggcccacgccacttattccatcaaaattgaggggaaaccataccttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagaggattactgcagttagataatatcagttatggtattgaaccattggaatcttcacctacatataagcatgtagtttatcgaattaaaaatgatgctattggtcattcctcctttcaagaaaattatcctgtggctcaatatatagatcagtcctacaggattcttgtcaaatcagacataaattcaggtgccatgctatcgaaaagaactctgaaaatacaaatcattatggataaagccatgtatgcttatatgggctccacggtggcagttgcagttgagaaagttttccaaatctttggtcttatcaacactatgttttcccagcttaatatgacagttatgctgtcttccttggagatctggtcagatcaaaataagatttcaacaagtggtcatgctgatgaaatactacagcgatttttgccttggaaagaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatatgatcccatggtatgaagttttttagcagttgcagcatggatggatttaaacggatagttctgcagcctgaacttaaatgttttcaggataaaacagtttcaaaaatgacttaccgaaaatcttcaacttgtggcaatggaattttggaacctacagagcagtgtgattgtggctataaagagngacaggatttcaccatgttggccaggctagtctcaaacttcggacctcaggttatccacctgcctcagcctctcaangtgctgggattacaaacccacaaggagtcccttgcgggaagactgccaatatgtctgttaggggatactttaagaacctgtaaaatcaacacaagttatttacttaaaagcacagcatacacaaccccattttggaaaaggagaaatagacaagaagaaatgggtaacaggcctcaagcaagtctgaaacccaagagagccaatgatggacattcagactcctgaataatttcctttgatgacatgtcctgcatcttctataaacaggcatgcactcataaaaaatgctgtaatcctgcagattgtactctagttagatctgcagaatgtggcactggatcatgctgtaacaataaaacttgtacgatccacgaaagaggccatgtctgcagaaaaagtgtagatatgtgtgattttccagaatattgcaatggaacatctgagttttgtgtacctgatgtgaaagctgctgatttagaatactgcagtaataagactagctattgctttaaaggagtatgcagagaaagggatagacagtgttcacagttatttggaaaatttgctaagtctgctaatcttctgtgcacagaagaagtgaattttcaaaatgacaaatttggaaactgtggttcccgttgtgatttttttgatatcctttgtggaaagattgtttgtcactggatacattcagaactagtaccaatgacagacttagacatacaatatacttaccttagaggtcacgtatgtttgtccgcacatgcaagaaatggttcaaaacaatcggagacctatacagaagatataactgcatgtggccaacacaaggtatgtcactcccgagaatgcagaaattttagtgaactaaatataacaaaatatactacaaattgtggacagaatgggatttgcaatgaacatttccattgtcaatgtgatcctggttatgctcctccagattgtgagccagcaatgtcatcaccaggaggaagtatcaatgatggattttggcttacagtagaaaaaagtgtacccttgcttccaaaacgacgtgctgctcctaaaaacaatggtcttttgatcagtttctacattttttcacctttgctcattttaattgctattgttagtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 466341 - DNA, 2905 bp, Homo sapiens
gttctcaagtttttcacccaagatgctgaacaggggcgtgaagggtgagtcccgcctcagtcactcagcaggggtccgcagcagcccctggcaggccttggcagggctcttttccacccagggggagactgggcaggtgtcccacgctgggcctggctgcctcttcccctcctccttcctgctctggacagtggatctcatcctcatcctgacagagctcagcccctggaggcaggggaggaggagctggggcattttcccagcccctccctcacctgtgggtcccagttcccaaggcttcccccaaccccaagacctaggggctctcaactttccccccagactatcccaaggacaaaacaaggtgatttgcgcacactgctggcacctccacttctctccaaagataccagctgagccctctgcctcctccctgacctgtctgggcctccagtatacattgagccaagccgggtggcctctcggagagctggtgctgaccaagacaccgcagccagcctgcgccgtggactggggggctccaggactttcagcctgctcacccccaatgtcctgatgatccttcttccttagcatcacctcagatggctttttctttaccaactgtacccattttacagatgagagactgaggtttagaatggagaaggagctgcctgaggcaacagagacagagagccagaactgaaacgaggcacccccacccgacccctgcgacccaacacccaccgtgtcctgttcctctgcaggcctctgaggttcctaaactacatgaccacatattttgagacctttgagtttttatgaacgctctccagagtttcccaatctctatgtttcattagctgtgctcacctgggcctgcctcctttctctgaatgctttgcgtggaggtggctgcacaccttcgcactggatgccaagcaagagcagttagcctgagagttcactctgcaaaaaagaaaacaaataatgagtctgtgctttgacgctgggtgttatcaaacatctttgtaattttttttatattctagatgcaaatctcttataagatatacgatttgcaaatattttatctcactttgtgtttttttttactttcttgatggtgtcttttgaagtgtaaaaagttttaattttgatgatgttcagtctattttttttctgctgcttgtgcttttgatgtcaatctaagaaactatttcccatttaagattctgaagatctacacctgtgttttcttctaagacatatagttttagcttttacatttaagtctttgatccattttgaggtaattttggtatatggtgtgaggtagggatactccttcattcttttgcatgtggatattcagttgtcctagtaccatttgctaagaagatttttcttcctccattgaatcatctggctaccctcatcataaatcaattgacgataaaagtgagagctcatttctggactcatagttctattccatttaaataaaggtctttcctatgccactgccaaaatgtcttgatcactattgctttgtagtaagttttgaaataggaaaagaatgactgttccaactttgttctttttccaagattattttgacaatttcaggtcctttgaatttctttataaattttagggtcagcttatcaatttccaaaaataaatcagctgaaattttgatagggattgcattgaatctgcacatcattttggataacattgcgttcgtgacaatagtaagtcttttgtccatgaatatgggatgaatatgggatgtttttccatttatttaggtcttctttaatttctttcaacaatattttgtagttttgaaagtaaaagttttgcacttcttttgttaaacttattcttaagtattttattcttgttcatgttattgtaaatgttgtttagaaatatatttgatttttatatatcgatcctatattctgcaactgtgttgaacttgtttattagttctaataatagtttttttagcgaattccttaggagtttatgtataaaagttcatttcttcttcaaatagagatcattttatttcttacttttcaatctagatacattttattttttttcttacttaatttcgctggttagaacctccagtaaaagttgaacggaagtggggtctgagagtttgaaatgaactaacccttggtgtgcatactggctcagccacttactagttcagtgactttgggtaagctgacttaatctctctgatctccagtttcttacaggcaaaataaagaggataatccttccctcataagacagctttgagaattgaatgaaattgctcctctagagtgccttctacaagtccatactatcatgtaagtgctcaaaaatgtttttttatttttgtcctccccactcagtgctacagtaacagaacctttggtccagagcctgggatgttgccttttgcccactggaattcccatcttggaagagtaagcgcaggggattgtccagacagccaggaggccagcgaagccaagtccttcagtacagcctgggagcctccaggaagctgttaggagttgccatgatgggtgcatttggactcacagaatctgccttccaatctcagtgctgcttctactcctttgctaccttaggtctttgaagacaggtccataccttgggtgtttgtatttggacaaccacagacattgccaagaaatgtatctgttctacttgcacaccttcaccacctggatgctgcttgaggacacagatctggtccatcagatttctctctgtactcctctctatatttcgccatatttgatatagacccatcaatggctccctagaataaaatctcaactcttcactgtgcccacagccccag

SEQ ID NO: 466342 - DNA, 1417 bp, Homo sapiens
tccacgggatagtcccccgattctaggaactggcagggggaagcaagcctaaagaaacatctagtgaagcttcagagagccgtgctgagaacaggagtccctgcgaggcccgggatgaagatcttctctctggatccggaagaatcataatatttgtcaactctgtaaactctcgggaaagcacttgtgctagcaaggtaacctggcctttgtgaattcatgcactagtctccatttctgggaagagcttcagcaccagcagcacataccactgtgagggcaagtgaaaaagtatcactttgggtagatggatataatcctcccgtaaagcttcatttgcaagaaaaccactatcacccttttccacctgtggaataaagatccttcttacatgtccaagatcacctgtcgccagcaggccctccccgcccgggcccccacagtcctgcgaagcctcccccctatgcccccagcactcgccagaaccagtagcccaggaagcaggctcgctggccaccaggagcccaagtaccctccccgcaccagtcacacagagacccgctgccaggccggtcagcgccagcagggccccagaagctcctcaggctccagctccaggggctgctgggctggcgggcaaggttccgctcacccccagaaaaggagacggagacccacaaggacctcagcttgtctggtgctggaggcctgggctgtcagaatgcctcgtcgttccggcagggggagcgcatcgccccctagtgccgcggccagaagctgtcacatcccgagtcgcaggcgcctcagcgcaaggggcgggctggaggtgccactcccattcatagaccaggaatcagagccctgggctggaagagtctgagcaggagaaaccctctgggcacccaggctggcatgtgcaaaggcgtagaggcaagctccccctgacacacggctggaggggaagctctaagtgctgcgcacaggctgttcacactgcatccttctccctggacttgctccccccacagcacctccatccttccagttagctatccaggccaccaccctcaccctctcacacccacatcctgtgggccccacatttgagagacaagaattcagttgcttctcaccctccatgggtgctcatcacctggtctgagtccccatcctctctctccccatacttggtctctgcttccatccttgactcctgacgtctaattgcaactcaatactaggtcagatcatgtcacacttctgctctggtgcaagaattatgtggttccttcagttcagtgtccaccaggatttgatattcccaaggcacatctctcactcctttgttctcattttaccttcacacaggaaaacactttttcttcttgaagtgtgctgttatgtagctactcttggc

SEQ ID NO: 466343 - DNA, 1540 bp, Homo sapiens
tgatttttctttgattttatgggggttccacagtgccaatgaacagaacttgtggacacccttttcaggcttgcaattgccccagtgggcctctgagacactctctcaaccttatctgaacccgtgagaggccagttcgaagtgtgagaacactgctccaccttggagttgcctttgtcttggttcctgccttctcagagagccgtgctgagaacaggagtccctgcgaggcccgggatgaagatcttctctctggatccggaagaatcataatatttgtcaactctgtaaactctcgggaaagcacttgtgctagcaaggtaacctggcctttgtgaattcatgcactagtctccatttctgggaagagcttcagcaccagcagcacataccactgtgagggcaagtgaaaaagtatcactttgggtagatggatataatcctcccgtaaagcttcatttgcaagaaaaccactatcacccttttccacctgtggaataaagatccttcttacatgtccaagatcacctgtcgccagcaggccctccccgcccgggcccccacagtcctgcgaagcctcccccctatgcccccagcactcgccagaaccagtagcccaggaagcaggctcgctggccaccaggagcccaagtaccctccccgcaccagtcacacagagacccgctgccaggccggtcagcgccagcagggccccagaagctcctcaggctccagctccaggggctgctgggctggcgggcaaggttccgctcacccccagaaaaggagacggagacccacaaggacctcagcttgtctggtgctggaggcctgggctgtcagaatgcctcgtcgttccggcagggggagcgcatcgccccctagtgccgcggccagaagctgtcacatcccgagtcgcaggcgcctcagcgcaaggggcgggctggaggtgccactcccattcatagaccaggaatcagagccctgggctggaagagtctgagcaggagaaaccctctgggcacccaggctggcatgtgcaaaggcgtagaggcaagctccccctgacacacggctggaggggaagctctaagtgctgcgcacaggctgttcacactgcatccttctccctggacttgctccccccacagcacctccatccttccagttagctatccaggccaccaccctcaccctctcacacccacatcctgtgggccccacatttgagagacaagaattcagttgcttctcaccctccatgggtgctcatcacctggtctgagtccccatcctctctctccccatacttggtctctgcttccatccttgactcctgacgtctaattgcaactcaatactaggtcagatcatgtcacacttctgctctggtgcaagaattatgtggttccttcagttcagtgtccaccaggatttgatattcccaaggcacatctctcactcctttgttctcattttaccttcacacaggaaaacactttttcttcttgaagtgtgctgttatgtagctactcttggc

SEQ ID NO: 466344 - DNA, 469 bp, Homo sapiens
tggctgggaacacaggcacgcaccaacatgtctggctaattttttttaattattattttttgcagagacaaggtctcactatatggcccaggctggtctcaaacgatcttcatgtcttggcctcccaaagtgctgagattacaggcatgagccaccatgcctggcccaggttattcttaatctcaccttttagaggtaggtaagtattttgaaatatttttattccagacattttcctatatatgtgtatttatataagtgccaaaataggattactctgtaatactgttctgtagcctgtttcatttggatataaatcaagcacattataaagatatatctgtacagcacagccattcgtaatggctgcatagcattccatgttttcgttggctcttcagatgatctctaaattatttttgtacaaataactttgtgatggcattctcatcatcaatctatatctttg

SEQ ID NO: 466345 - DNA, 2416 bp, Homo sapiens
cccggccgccccgcgggcccctcgcagaagttttgatcgtcttcgaaacaaatccctctgctccacccccttgaaaaattgatttgggagttggggagcgaaggctttcttttttctcctctgccttctttattattaatattttgtaaagctccagcgctacgaggagtggccccgagcgaggccagactgcgcggacggcagggagcgcggcggctccgccaggggacggcgccggccgggagtggccgcttgggaacccccgactgtcggccgagggttgtcgagaggctgaaacataagtgctcaccacaacacccagcacctaccaggcctctatacatatttgcctgtctggaaccgggagcttccccagctgaggaccacagtgagagcagagaagacccaggatcgtatttgaaaccataaaagccacatgaagacactaagaataacttgcagaaagacattttctatgaattgaacacagagtcccaaaacccagaaagttccttggtctctatctcatgggcccgtgtctggggaagggggcccgatgtgaggctggggccagtgcccatcctatttgatctttatcttaaatccacttcaaaatgctgtggcttggtggattgaaggttcgccccttcctgtaattatttggtgtctggtaaagtttttatgagtgtttgtgcaaatacatgcatttgatgtgcatttgttttggacacccactggattccgtttgccagggagcatttgtcttggtcactccagctgtcaacctttggctcctcccctggtcttcagcccatccccaaaaggaatcactgtatgtacactggggaactgcatccagaaccttctctcaccccacccctccatctgcatccaaggctgtgtttccagattcagggtttcatgttacacagagttattctttctggaatgtgtcccccaagcaaccccgctggaccctctgtggaaggaggggctcttctgaatgcaagattcgcatgtatgcaaaaaagcaaacatgccagccctgcgccttgctagtgtctgtccctgaaacagaaccagcaaccagcggacaaagcagtgcccaggagttgggccaggctgcaaacatcatcaacaacagtaatagtaataataataacctttattaataaagcctctgacctagaatgatctcatggaatcctagagtaaggctgggacgtagctgtcattacaattgtatgaataaagagacttgtgggtaggggggccttgtccaaggtcgctgagtggcagaaccaggcgggtggccgcagccctgacactgtcacctgtgggctgggcagcctcagaggggtggtgagtcaggcatattgttgagctctgtgggatctagacagccctgcaactgtccccagtgtgcagaaaagccagaaaattccatcttggcgtcctgacctccacctccgctccagctcacacaatctgcccagttgagttattctccctggaagagcttggtaatttgggcttttccaaactcaggaaaagcctccaagtctagaatcctccccgtggcctctccctggcctcatctcttcctccctccccttggctctccatgctacgctgagtgccgagcacattggcctgatttctgtttctcaagcagctcatactctgtcctgcctccaggctttgaatgggtcgttcccttcacctggaaagccctcttcactccctcttcctagcttattcctgttcatcctttctgtctcaatgtaaaggtcacctcctcctggaagccttcctttacctcccaggctagcttagagctacctcttacatgttctcagcaacccgtgattgtgattctccttcatggtgagatggggttgcatgtctttttcattcctcattctacgccctcgcagtctcagagagaaacccaggaacaatgagaaaggagtgatggggaggttgctcttcagtgtcaaggcggtggaaggggatctatgagatggagaagggacatatacccttgaatattacatagtccacgttgtgctggttctgtagctggggatatgcctttcccatgtagatcagccaaagactcaaggcaaaaaacaacaggccagcttcccactggggcccattgtgggggcaattgtaagaaagtggagagccccgccctgtgggctttaaatcttgttccacttcagacactttcacagctctgacatcatgaatactgtaatcacccagcacaggagggactgcgattcccagaactctgacatcaacagcctgtgaggacagcaagctggatgtggctcgctctgaacatctgcctctccactcaggagacctagctccttgcagagcctcattcttccacgtgtttcagggc

SEQ ID NO: 466346 - DNA, 648 bp, Homo sapiens
cccggccgccccgcgggcccctcgcagaagttttgatcgtcttcgaaacaaatccctctgctccacccccttgaaaaattgatttgggagttggggagcgaaggctttcttttttctcctctgccttctttattattaatattttgtaaagctccagcgctacgaggagtggccccgagcgaggccagactgcgcggacggcagggagcgcggcggctccgccaggggacggcgccggccgggagtggccgcttgggaacccccgactgtcggccgagagacaaggtctcactatatggcccaggctggtctcaaacgatcttcatgtcttggcctcccaaagtgctgagattacaggcatgagccaccatgcctggcccaggttattcttaatctcaccttttagaggtagaaagtggagagccccgccctgtgggctttaaatcttgttccacttcagacactttcacagctctgacatcatgaatactgtaatcacccagcacaggagggactgcgattcccagaactctgacatcaacagcctgtgaggacagcaagctggatgtggctcgctctgaacatctgcctctccactcaggagacctagctccttgcagagcctcattcttccacgtgtttcagggc

SEQ ID NO: 466347 - DNA, 2141 bp, Homo sapiens
gcggggccccgcggaggggcccggctttgtggaggattagaggctcccgccctaccctacctgcgtgtgtgtcgcctgtctggaaccgggagcttccccagctgaggaccacagtgagagcagagaagacccaggatcgtatttgaaaccataaaagccacatgaagacactaagaataacttgcagaaagacattttctatgaattgaacacagagtcccaaaacccagaaagttccttggtctctatctcatgggcccgtgtctggggaagggggcccgatgtgaggctggggccagtgcccatcctatttgatctttatcttaaatccacttcaaaatgctgtggcttggtggattgaaggttcgccccttcctgtaattatttggtgtctggtaaagtttttatgagtgtttgtgcaaatacatgcatttgatgtgcatttgttttggacacccactggattccgtttgccagggagcatttgtcttggtcactccagctgtcaacctttggctcctcccctggtcttcagcccatccccaaaaggaatcactgtatgtacactggggaactgcatccagaaccttctctcaccccacccctccatctgcatccaaggctgtgtttccagattcagggtttcatgttacacagagttattctttctggaatgtgtcccccaagcaaccccgctggaccctctgtggaaggaggggctcttctgaatgcaagattcgcatgtatgcaaaaaagcaaacatgccagccctgcgccttgctagtgtctgtccctgaaacagaaccagcaaccagcggacaaagcagtgcccaggagttgggccaggctgcaaacatcatcaacaacagtaatagtaataataataacctttattaataaagcctctgacctagaatgatctcatggaatcctagagtaaggctgggacgtagctgtcattacaattgtatgaataaagagacttgtgggtaggggggccttgtccaaggtcgctgagtggcagaaccaggcgggtggccgcagccctgacactgtcacctgtgggctgggcagcctcagaggggtggtgagtcaggcatattgttgagctctgtgggatctagacagccctgcaactgtccccagtgtgcagaaaagccagaaaattccatcttggcgtcctgacctccacctccgctccagctcacacaatctgcccagttgagttattctccctggaagagcttggtaatttgggcttttccaaactcaggaaaagcctccaagtctagaatcctccccgtggcctctccctggcctcatctcttcctccctccccttggctctccatgctacgctgagtgccgagcacattggcctgatttctgtttctcaagcagctcatactctgtcctgcctccaggctttgaatgggtcgttcccttcacctggaaagccctcttcactccctcttcctagcttattcctgttcatcctttctgtctcaatgtaaaggtcacctcctcctggaagccttcctttacctcccaggctagcttagagctacctcttacatgttctcagcaacccgtgattgtgattctccttcatggtgagatggggttgcatgtctttttcattcctcattctacgccctcgcagtctcagagagaaacccaggaacaatgagaaaggagtgatggggaggttgctcttcagtgtcaaggcggtggaaggggatctatgagatggagaagggacatatacccttgaatattacatagtccacgttgtgctggttctgtagctggggatatgcctttcccatgtagatcagccaaagactcaaggcaaaaaacaacaggccagcttcccactggggcccattgtgggggcaattgtaagaaagtggagagccccgccctgtgggctttaaatcttgttccacttcagacactttcacagctctgacatcatgaatactgtaatcacccagcacaggagggactgcgattcccagaactctgacatcaacagcctgtgaggacagcaagctggatgtggctcgctctgaacatctgcctctccactcaggagacctagctccttgcagagcctcattcttccacgtgtttcagggc

SEQ ID NO: 466348 - DNA, 856 bp, Homo sapiens
tactaaattcgcggccgcgtcgacgttcaactccattagttgaaagaccacatcacaaaaaagtttctcaggatgcttctgtgtagtttttatgtgaagatatttgattttccacagttggcctcaaagcgctccaaatttccactcacagattctgcaaaatgagagattcaaaactgctgaatcaaaagatagtttcaactctgtgacttcagtgtccacctcacaaagatgtttctcagaatgcttctgtgtggtttttatataaagatatctccttctccaaaatggatctcaaagttctccaaatattcacttccagattctatggaaagattgtctcaaaattgctcaatcaaaccaaaggttcaactctgtgcgatgaacgcacacatcacaaagaagtttctcagaatacttctgtgtagtttttatttgagtatagttccttttccaccacagaccacaaagggctccaaatatccattgcagatgatacaaaaagagagattcaaaactgctcaaacaaaagattgtacaaaaagagagattcaagactggtcactcaaaagagaggtccagctctgtgagttgaaggcaaacctcacaaagatgtttctcagaaggcttctgcatagtgtttatatgacgatatttgcttttccacaatatgcctccaatctccacaattatccacttgcagattctacaagaagagtgtttcaaaactgctcaatccaaataaactttcaactctgtgagatcaatgcacacatcacaaagaagtttctcagaatgcttctgtagagtgtttatctgaagttatttgcttttccacgataggcctcaaagcaca

SEQ ID NO: 466349 - DNA, 857 bp, Homo sapiens
agcagctggaaccacagtccatttcctcaaccctcacagaggaatgcttctcaaagatttctcaaatgcaggttcatggactagtgataattatgaaattaacaatttggacaaaatgagagacaaagaaacaagaggagaagcacctcaagaaactgacatccagatgggaatcaaaattcagacaggtcccttctacaaggtccttctgactcattcctggtcacgggcagagggggtggagcagaaagtgaattacagatttgctgaggtcagccctgctcagcttgctggctacacaaagataaagacatttacagggaagtggagtggaagctttcctccccgcattggtctagaggtagaagtgtgcggggaggaagatctttcctccatggatcaacatggggaatgcaggggggtgctgggagtcacaggaaacagccaatgaccagtaagcatcacaaagaagtcatgccaaagaaccagacaaatagctggaaggaagaggggaactcctttgtgacgccaaatgggccaaagggtcgctgggaaaactaagccttactgtccatcttgccttcaggataatgtgaaatatggcctaatttttgaagtttttttcttagaaattttactgaatccaaaataaaacaagaagatcatgagtccagaattctcttttctcaacactagatggcagtagagttaaagaaaaaaatcccagcagttctttgtacagggatttggtgatttttcccataaagctgcgatgaggatgaactcagagcaaaatctatgtaagtagaaagttaaattacaatagaggtgtgaaatgatgctttaacatgtcacac

SEQ ID NO: 466350 - DNA, 1028 bp, Homo sapiens
agcagctggaaccacagtccatttcctcaaccctcacagaggaatgcttctcaaagatttctcaaatgcaggttcatggactagtgataattatgaaattaacaatttggacaaaatgagagacaaagaaacaagaggagaagcacctcaagaaactgacatccagatgggaatcaaaattcagacaggtcccttctacaaggtccttctgactcattcctggtcacgggcagagggggtggagcagaaagtgaattacagatttgctgaggtcagccctgctcagcttgctggctacacaaagataaagacatttacagggaagtggagtggaagctttcctccccgcattggtctagaggtagaagtgtgcggggaggaagatctttcctccatggatcaacatggggaatgcaggggggtgctgggagtcacaggaaacagccaatgaccagtaagcatcacaaagaagtcatgccaaagaaccagacaaatagctggaaggaagaggggaactcctttgtgacgccaaatgggccaaagggtcgctgggaaaactaagccttactgtccatcttgccttcaggataatgtgaaatatggcctaatttttgaagtttttttcttagaaattttactgaatccaaaataaaacaagaagatcatgagtccagaattctcttttctcaacactagatggcagtagagttaaagaaaaaaatcccagcagttctttgtacagggatttggtgatttttcccataaagctgcgatgaggatgaactcagagcaaaatctataactcaggtggcagagaggagaagcagctggacatcggagactatggctggacattggagagaagtggtttgacttcagagggacagcttgacagtgaagaattcggccagagatagctggacttcaggggaagatgatctttccgcctcatccccctttcagctccccttcctgctgagagacactttaatcggcaataaaatcccccatgtttaccatccttcaaa

SEQ ID NO: 466351 - DNA, 1945 bp, Homo sapiens
tggagaactatggtctcggtggtgtccggacgcactgaggcatcctctctaccctcacccactcgcccgagctgtgctgggtccccaaaagccccagtgggacttccttgcccgcacctgcccttgcgcagctggaggcgagggaagccgcatgtgatccttacggatagctgcgctgtcttcagacgctcagagcatcccccactgaccttagctttctgcctttccagctcctttacagttgggatgttttttattgtcgaaactcacactggacagaaaccctatgaatgtaatgagtgtgaaagggcattctctctgggatcaaccattatgaagcatcaggggaatactactggctcgggtgcccgaattgaagttctctttggtctccaactgtctcttcgtcttccttggctagagtcttactgcaacaaacggaccccactatccttaaaagaaaaggctagcttgtgccaatgggccagagtggaacaggcatcccatggagtatacctggaagattcctgggtcttctgcatgagttgcccctaatgcccacagtgtttctaaacgagaaggcagcctgggcgacagagcaaaaccccatctctaaaaaataaaataccctatggctcttcccacaactgctcattctctgacatcttaatgctcccactgtcccactgaagacgggctgctttcctttccattctcgtaagtcctccctccgggcccgtgctcctcacctgcccgggtcgcacctggcctctcccctcactccgcttcacccccgcccgccgcccgttccgcaagcgcgtctcagcaccgagtggttggttctcgaactccagctccaccgcaataggtctgaaacctctctgcacctcggcttcctcatttaagcgatggcagcagccttctagagggggcgatgaggtcaaaagactacaggtgggaagtgctaggtgcacagcgggcgcgagctggattctgagcttgatcactacttggaggtgggggaaaagtcgcccgagagagggggacagtgcaccgcgagacgtcctaggtgaggaagggccgggtccagagcacggagaacaacccccggttgaggagcgtccgcaggaacgctcggtgtcggggtcccttccttcgcagccgcacgccgccggcggcacctctgcacctgcgccctctcgcccgcagactccgccaagggctggaagggacgtaaccgggaaggagcaggactgccggagcattgagtactatcagccgcctagagcggacccacgaaacctggaattcaattggttggtgagctgaagggcagggcggaagttcagattaggcatttccggcccagggggcttggctccccgcggcacgggatttagcgttcgcgctccttcccttcccgtggtcgagccgacaccagagcctggtccgctgttctcagctgtttgccgtctgcgcaggacctcataggtgggcctgggaaacgcagtccattgtctctcctggccaagtgcactgccacagtcctggctttcacatggtggcctcaggatgctgtcatcccaggggcctcaggaaggcctctcttgagacatggagaggtcctgacctgagggctgcatcaagatcttgtcattccacatcgtggtttcctttgaggatgtggctgtacccctctcccaggaggagtgggactgtctgatccctgctcagaggggcctctacaaggatgtgatgatggggacctatgggaacctactctcattagtaggtgaatggttaagcaaactgtggtacatccataccatgggatacgactcaacaatcaaaaggaactgcccagacttcaccacgatgcaatatatgcatgtaagaaatctgcacttataccccctaaatatataaaacatttttaaaaaaaaaa

SEQ ID NO: 466352 - DNA, 1758 bp, Homo sapiens
tggagaactatggtctcggtggtgtccggacgcactgaggcatcctctctaccctcacccactcgcccgagctgtgctgggtccccaaaagccccagtgggacttccttgcccgcacctgcccttgcgcagctggaggcgagggaagccgcatgtgatccttacggatagctgcgctgtcttcagacgctcagagcatcccccactgaccttagctttctgcctttccagctcctttacagttgggatgttttttattgtcgaaactcacactggacagaaaccctatgaatgtaatgagtgtgaaagggcattctctctgggatcaaccattatgaagcatcaggggaatactactggctcgggtgcccgaattgaagttctctttggtctccaactgtctcttcgtcttccttggctagagtcttactgcaacaaacggaccccactatccttaaaagaaaaggctagcttgtgccaatgggccagagtggaacaggcatcccatggagtatacctggaagattcctgggtcttctgcatgagttgcccctaatgcccacagtgtttctaaacgagaaggcagcctgggcgacagagcaaaaccccatctctaaaaaataaaataccctatggctcttcccacaactgctcattctctgacatcttaatgctcccactgtcccactgaagacgggctgctttcctttccattctcgtaagtcctccctccgggcccgtgctcctcacctgcccgggtcgcacctggcctctcccctcactccgcttcacccccgcccgccgcccgttccgcaagcgcgtctcagcaccgagtggttggttctcgaactccagctccaccgcaataggtctgaaacctctctgcacctcggcttcctcatttaagcgatggcagcagccttctagagggggcgatgaggtcaaaagactacaggtgggaagtgctaggtgcacagcgggcgcgagctggattctgagcttgatcactacttggaggtgggggaaaagtcgcccgagagagggggacagtgcaccgcgagacgtcctaggtgaggaagggccgggtccagagcacggagaacaacccccggttgaggagcgtccgcaggaacgctcggtgtcggggtcccttccttcgcagccgcacgccgccggcggcacctctgcacctgcgccctctcgcccgcagactccgccaagggctggaagggacgtaaccgggaaggagcaggactgccggagcattgagtactatcagccgcctagagcggacccacgaaacctggaattcaattggttggtgagctgaagggcagggcggaagttcagattaggcatttccggcccagggggcttggctccccgcggcacgggatttagcgttcgcgctccttcccttcccgtggtcgagccgagtcctgacctgagggctgcatcaagatcttgtcattccacatcgtggtttcctttgaggatgtggctgtacccctctcccaggaggagtgggactgtctgatccctgctcagaggggcctctacaaggatgtgatgatggggacctatgggaacctactctcattagtaggtgaatggttaagcaaactgtggtacatccataccatgggatacgactcaacaatcaaaaggaactgcccagacttcaccacgatgcaatatatgcatgtaagaaatctgcacttataccccctaaatatataaaacatttttaaaaaaaaaa

SEQ ID NO: 466353 - DNA, 3352 bp, Homo sapiens
  misc_feature (3348)..(3349): n is a, c, g, or t
tggagaactatggtctcggtggtgtccggacgcactgaggcatcctctctaccctcacccactcgcccgagctgtgctgggtccccaaaagccccagtgggacttccttgcccgcacctgcccttgcgcagctggaggcgagggaagccgcatgtgatccttacggatagctgcgctgtcttcagacgctcagagcatcccccactgaccttagctttctgcctttccagctcctttacagttgggatgttttttattgtcgaaactcacactggacagaaaccctatgaatgtaatgagtgtgaaagggcattctctctgggatcaaccattatgaagcatcaggggaatactactggctcgggtgcccgaattgaagttctctttggtctccaactgtctcttcgtcttccttggctagagtcttactgcaacaaacggaccccactatccttaaaagaaaaggctagcttgtgccaatgggccagagtggaacaggcatcccatggagtatacctggaagattcctgggtcttctgcatgagttgcccctaatgcccacagtgtttctaaacgagaaggcagcctgggcgacagagcaaaaccccatctctaaaaaataaaataccctatggctcttcccacaactgctcattctctgacatcttaatgctcccactgtcccactgaagacgggctgctttcctttccattctcgtaagtcctccctccgggcccgtgctcctcacctgcccgggtcgcacctggcctctcccctcactccgcttcacccccgcccgccgcccgttccgcaagcgcgtctcagcaccgagtggttggttctcgaactccagctccaccgcaataggtctgaaacctctctgcacctcggcttcctcatttaagcgatggcagcagccttctagagggggcgatgaggtcaaaagactacaggtgggaagtgctaggtgcacagcgggcgcgagctggattctgagcttgatcactacttggaggtgggggaaaagtcgcccgagagagggggacagtgcaccgcgagacgtcctaggtgaggaagggccgggtccagagcacggagaacaacccccggttgaggagcgtccgcaggaacgctcggtgtcggggtcccttccttcgcagccgcacgccgccggcggcacctctgcacctgcgccctctcgcccgcagactccgccaagggctggaagggacgtaaccgggaaggagcaggactgccggagcattgagtactatcagccgcctagagcggacccacgaaacctggaattcaattggttggtgagctgaagggcagggcggaagttcagattaggcatttccggcccagggggcttggctccccgcggcacgggatttagcgttcgcgctccttcccttcccgtggtcgagccgagtcctgacctgagggctgcatcaagatcttgtcattccacatcgtggtttcctttgaggatgtggctgtacccctctcccaggaggagtgggactgtctgatccctgctcagaggggcctctacaaggatgtgatgatggggacctatgggaacctactctcattaggtaagttccctccctggggctcagctcctgggcttcctgctccttaaccttgaggatcaagcttggggctcagaggctcctcaccccctgggcccaaagaccagacattttgaccatggtaccatgcaggtctggtttgcacagagagggggacaggtggtactgggaccctccttgatttttttttttaataggcaatgtctcactctgttgcccatcctggagtgcagtggtgagaccatagctcactgtaaccttgacgtctttggttgaagagatcctcctacctcagcctcccaagtacctgagactacaggcatgggccaccatgcctgtcttattttacttttttagagacagagcctctgtgttgcccaggttggtctcaaactcctagcctcaaggaatcctcccaccttggcctcccatgcctttccaaccctccctgatttatagaaggagaatattattcattgcacacctagtacctccctatcccctgaattaatctttctgcatcttgatgatcggtggtaggatacacagtttataaacgaacctgaggctaacaaatactgtcacttttcttaagtttacacagcctattggtggcagatctgggatatggatctgttcggtttcagagccctgctttcctttcactggaatgtgctcttcgctttagcccttttttttttttttttttggtttctgctagcctttatttgagaaaatttacacaaaaatccccaatgcaacatttacaagtgaatctgtataaatcccatatgcctctttcccaaactgaaaaatggctttatgacaggggtccatgacaatggtataaaaatacttacttaaactgcatcattctcatttatattatacagaccattttggataatatgctcaaaagtggaggaaagcacataacacccctgtttttaaagattatttgctcttgtatcagtcttttgtcaaaggcaaatacttttacttcttggataaaaccaaggtataatatcaattaacttttaaaccaaaagcacaaaatgtcctagttgatagttttggcatgagtaaagggaagggacatgagagaacatcagctcctacaaagcttaagtttagggtcacacttgggaacaaaagcatcaacaaaacaaaatattctcttctcctatcttcttgacattttgtcacatcagaagaacataactaacagagtagctttcattgctcctgaaaaggggaaaggcaccagtcagaaataggaaagaaaatcttgttaggttaatggtacatgatagaatttcacattaaaaagtttaatgatggaggatgggcgtagtggcttacacatgtaatcccagcactttgggaggctgaggtcagtggatcacttgaggtcaggagttcaagaccatcccggccaacacggtgaaactccatctctaccaaaaatacaaaaaccagccaggtgtggtggcatgcacctgcactcccagccactctggaggccgaggcggaagaactacccgaacccaggaggtgaaggttgcagcaagctgagatagcaccattgcacttcagcctgggcatcgcagcaagactctgtcccaaaaaaaaaaaaaaaaaaaaaaaaaagtttaagaatggaatccaagtagacttggatgtaccctctgtaacttagtatatgtaatactacatgtagactttctcaacatctgctgcctatggtgnntct

SEQ ID NO: 466354 - DNA, 901 bp, Homo sapiens
gcctccacgggcagtacttcccactctgctgcactgccttgctttcctcctggcggggaagaaagaaggaaggaaagaagacccagagctggaatcatacacatcatcgcaattcatccacaccgcagtcctgtaagggatagaaaggaggtcattcgaagagatgatggcacgggacccaggacctgaggaagctgcagtgggtgaaggggagaaacagaggagcaggggctggagaaagagtggggagtcatcaaccaccctcctttctcctggcgtctggttttcggggcccagaggtcttctctagggcctcagagaagcttccaagtctgttcatttctctttccccacccctgcttgtatcacaaataaagaaattattgacaactgaaaaaaaaaaaaaaaaacaaaaaacaaaaacacttggggggcgcggggccccacgaaaaagctctcacacaacactctgcgagtgggcgccgaggccccacaaggacaccgacaccgcgcgcacagaccgtgtccccaagggaacacccgggcaccacaccacatgggggccgggacctcccaagcataaaacaacgcccccgggggggacacaccgagacgggtctcccagcaccacatccccagaaacgggatacacgaagagaccaaacacggacgcctctcataaacaagcgggcgggacttccaccagagcgaagagcgccgccgaagacatcgaaaaatataagcccccgggccacggggtgggggacgaccccacggacgcacagcaacacggcgggacacacagaccacgaactgacacccgccgcaacacgtaggcaacaagaaccgaagaaccacacacctacagaaaggataacagaacatacgcaccaaaagcagt

SEQ ID NO: 466355 - DNA, 610 bp, Homo sapiens
gcctccacgggcagtacttcccactctgctgcactgccttgctttcctcctggcggggaagaaagaaggaaggaaagaagacccagagctggaatcatacacatcatcgcaattcatccacaccgcagtcctgtaaggtatgtgccattgtactcagaaaactgaggctcaaagagattgagcaacttatctaagacctcacaggtcctgagagcagagtctggatttcaaacacctgggagactctgaaatccatgttagctcttctatacatgggcccaaaatgcagctgtacaccagcaagactgaattcctcttgtggcttatcactagctctgaatacaagaatcttcaaaatgctttataaacaatagtagcgtcatgggaataagttgacaagttcccagaattactgttttagatgcacttgaactttttctccatgtatagagtcaggaataaggaaaaaggatccaaaggagaaggagaaaaataaaacgggactgagccttatacttcttgaccagaacagataatgttgggattttccttactttttttccagacaaatccaataaagacatctgtttctgttacctaaaaccaactt

SEQ ID NO: 466356 - DNA, 963 bp, Homo sapiens
gcctccacgggcagtacttcccactctgctgcactgccttgctttcctcctggcggggaagaaagaaggaaggaaagaagacccagagctggaatcatacacatcatcgcaattcatccacaccgcagtcctgtaagggatagaaaggaggtcattcgaagagatgatggcacgggacccaggacctgaggaagctgcagtgggtgaaggggagaaacagaggagcaggggctggagaaagagtggggagtcatcaaccaccctcctttctcctggcgtctggttttcggggcccagaggtcttctctagggcctcagagaagcttccaagtctgttcatttctctttccccacccctgcttgtatcacaaataaagaaattattgacaactgagttcctgactaggtggcaggattttagggacccttcacctcgtctgaaactcatgaaggtagtgggaatcccatggatgtctgcacgaaattagacattagtacagtgacctcctgggataagggactaccaggttgcctaaggaggggcaaaccggcctgggttggagacaaagcagggcacaactcccagtttgaccagcagggggtcatgcctgtggacagccacgcagcagggagatcctgcccatggacagccccgcagcagggagatcgtgcctgtaaacagccccgcagcagggggtcatgcctgtggacagtccctcaccaggggttcgtgcctgtggacagccccgcagcagggaggttgtgcctgtggatggccccgcagcaggggattgtgcctgtggacagccccgcagcagggggtcgtgcctgtggacagctccccagcagggggatcatgcctataaacagcccctgcactccaggctgggaaacagaatgagaccctatttattaaaaaaaaaaggggggggatggggtggggagagaacacaggtgcacaag

SEQ ID NO: 466357 - DNA, 1013 bp, Homo sapiens
acagctgcaatgaaaaatgaatgcagagtcttcacctttcctgtacacactcgaggacaagaataaaaagtgagaaaaacaaaaatactaaacgtattcattccatccccgaagtattaattatgaaaccatatttcacagctgttgctaaaccatctctgctttcccataagtggctccctttagaaaaaccagaaaatccttgctgttattcctcagatcacagaacagcagtccccaaactgctcctttatcgacggagcaccaggagaaaaacagagctcactaacaaggaactcacttcggcacacttcactggagacttacccaggcgagctgtgtgggttttaggagacagaacagcaccacacgacttgccctggccaacggatgcagatgaagtaagagtgtgctactacagagcagaggcctttaatgacctccccagaaaacctaagccatagcctaaagccaaaccattccagccaccctgcagatctaccgaggaggaaaactaatgtttgttgttgtaagaagtaaaaatttagactacctcatttccatcctgggccctcgcgttccttcccctggctgccgttgtcagctcacctcatgcaccattctgagatgatcgatcaccagctggagtgtaaattatcacttcctagaggagagatttggaaatgagactgagccaggaatgaccattggagaagggtgttgcgaagactgcaattatatatttactattgctgacacaagaattatgacagattcattggtatgacccaacgctataactgtatgtagttattcagccatccttgtagtgagagaagattccagtacagttcacatggggccaccatttcggccaagtgaggtgcacggtactcattctctgtccttaagatctgaggggaggatgttgacagcattcaggtagacagtgaggggaaccatggccagtccacacctgtgcccagggcaagtaccccagccccttctctcct

SEQ ID NO: 466358 - DNA, 1213 bp, Homo sapiens
gcagtgcccgtgtcacaggtggtgatggctcctggaggtggtgcacacaagctcgtggcatggcatctggtgcacagaaagagccggccgtgggatgtggtcctcgtggggaccctgagagaactgcatcgagggacaagcctgaagggtgggacccatgtccttgctcactccacaggtgcagagagttccagcaaggtgatagacgctgacaaggccttccctggcttcctcctttcattggagaacaggcagacgctcaccagggccggcccggagccgagccgccgcgcagccgggcgggaggctgcgtatcagagctcctggcaggctcgcaaaaagctgtccccggcccgccgccgctctatcagcccacggagggagggcggcgggggagggagggaaaaagtatttgcttcagcccttaatcacggaatttgaaatcccagcgagtcggtgccatttattttcagaggctgtcaaggctggtttcagcatttaaaagaaaggaggataaaacgcatttgcatttctcccccactctcgctgcgcgctcgccggcgctccccctcgttccctgcgcagctcgcggggcactaactgagactcggttccctcactggtaaaatgagaaaactcacttatggtcaggggtccccgagttaatgccagtgaattccttggcagagcatcaagcacttggagaagcccccacccccggtcattgtgatgatggtttgtttgtttgtttgtttgttttgagacggagtctcgctctgtcgcccaggctggagtgcagtggcgcgatctcggctcactgcaagctctgcctcccgggttcacgccattcaggggagtggcgccgagacaccgtgtagcgcccatgccaaggaggaagcgagacagcaggagcggaggaaagaaccccgggctgtgttgaggaagcctcctacttttgcctgaagtgaggttgttgttgttgttgttgttgttttttccacgtgccttattcatccacgtaacctcagcctctagtgcagcgtcctattttttggcttgtattattatttttaattggcacataataattgtacatatttatgggatgcagtgtaatattttagtacacatatacaatgtgtagtggtcaaatcagggtaattagcacattcagggttggagtttttctgtcaatacagatacttatagaaac

SEQ ID NO: 466359 - DNA, 2955 bp, Homo sapiens
tgcaaagctgcctgcagcccagcagaaggtgtctgcgtcggttccacccctcacgtggctgccgcatttctccctccagaaccctacacctgcggcgcctgtgggatccagttccagttctacaacaacctgttggagcacatgcagtcccatgcagctgacaatgaaaacaacattgcctccaaccagtcccgatcgccacctgctgttgtagaagagaagtggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattagaaaaaaaccacacaacactgtcacaaagaaaaggaatttaagttctaaacactgtggacctcattataaatgccccctggaaacttaagtgctttttttatatgtgtgtgtgtgcgtgtatgtacacagccacacccctcctaccctcctgatcccattgtgcacccccccacacactcggctgctctgctgtggactctccacactgcatcagatggacggtttctgcactggactttgtttcttgttcaccttcagggcattgagctgctgcctttgagataccccttggggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttaggaagatgcagcgtatggtgttttttttcttgggtttgaggatgggccatactgtccagttaggagcagagcacctgcagggcccaggtgagtggagatgggccagagacagggcacctggggtgacagcacacatccatcccagcgggacactgtgtgatgctggcatcgttgacttaactgtggtgatggtggtatcagtgacttacctgtgagctcgcagctcatctcttgcaccagacctggctcagccagtgtttgataaatgagggagggacatggtcgaggaagatgtgaccctcctgggcttgtggagcattgtccca

SEQ ID NO: 466360 - DNA, 1383 bp, Homo sapiens
ggctcctgccataacccaggtgccagccggtctccgcctaggaccttccctcccgcccagccagggtgggcggcatcctacgcggtgaaacgagctcatggactgacccggggctgggcctcgccagccaggagagagcgagggccgcacggcagggctggcccaggcagctcgtccagggccattcagatcccaagcatcaggaaatcattttgtacaaccacccgaagcagagatattttttaagaagcgtaaattattttcagttgttttctgatcctgcctttttcttttccccacaacttcacgccagtgattcgttcacatcaggtaaatcttgagaaagccttggtgccctcctccccaccccccactcagtaaccacgtgcgtgcacccccgcatcctttctcagtagttaagacgttctaggcaataccatagacacatctgactgtgtctctctctttgagtgcaagaaactcaagtcatcttaaaaaaaaaaaaaatacaaaaaaaatttacaaaaaaacaaacacaaaaaaaatatcttttttaggccagagttttctacaggtattaatgaatatttttcttaatccttataagttttatgtgtttaatatttcttaataccggtagcattaatttatacttttgtagcaacacaatatttttataaacagccggtgcttggctcaagtcttcacgaggggtttaggcagggccatcttggggaccctgtgtaccatgtactgtatttaaaaaaaaaaaaagttacctattgtcacacttgctgtgttaattaacaaaagatgttgtgtgcggtctcctgtatcggtgtggatccaacagctctccagggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttaggaagatg

SEQ ID NO: 466361 - DNA, 2109 bp, Homo sapiens
  misc_feature (2109)..(2109): n is a, c, g, or t
ggctcctgccataacccaggtgccagccggtctccgcctaggaccttccctcccgcccagccagggtgggcggcatcctacgcggtgaaacgagctcatggactgacccggggctgggcctcgccagccaggagagagcgagggccgcacggcagggctggcccaggcagctcgtccagggccattcagatcccaagcatcaggaaatcattttgtacaaccacccgaagcagagatattttttaagaagcgtaaattattttcagttgttttctgatcctgcctttttcttttccccacaacttcacgccagtgattcgttcacatcaggtaaatcttgagaaagccttggtgccctcctccccaccccccactcagtaaccacgtgcgtgcacccccgcatcctttctcagtagttaagacgttctaggcaataccatagacacatctgactgtgtctctctctttgagtgcaagaaactcaagtcatcttaaaaaaaaaaaaaatacaaaaaaaatttacaaaaaaacaaacacaaaaaaaatatcttttttaggccagagttttctacaggtattaatgaatatttttcttaatccttataagttttatgtgtttaatatttcttaataccggtagcattaatttatacttttgtagcaacacaatatttttataaacagccggtgcttggctcaagtcttcacgaggggtttaggcagggccatcttggggaccctgtgtaccatgtactgtatttaaaaaaaaaaaaagttacctattgtcacacttgctgtgttaattaacaaaagatgttgtgtgcggtctcctgtatcggtgtggatccaacagctctccagggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttaggaagatggcaaaaaaaaaaaaaaaaaaaaaaaaaaaaaaaaaaaaaaaaaaaaaaaaaaaaaagggggggggggaaaaaaaataccccgggggggcccaaatgggcaccgtttttgttgaaaggggggccccaaaaagggggggaaaaaaagaggggggggggcgggtaaaaacggggggggggggaacacagcctgcacccggggcgacccctgtgtggggaggagaccccacaacgtcgcggccgccggggaccacatcggtgcggacaacccccccaaggagaaattaagacgagcccagaggcaacaaataaacctgcgcgagcgtcactggtgggtaaccccccaccagctaatagtcggcgccacggaaaaaatgcgcccccggactactcttttcgaacacactttacgacgccgacacacaatacgcaaaagacactaacccccgaagcacacagacagagaggagagacacacgacgagcaaatcgacagaccacaaaagcaggtagaccacgaagaaacgacaacaacacaaggaaaaaacaaaaacacaacacgagaaagcagcgaaaccaagagcgcacaaagacagcaagagaaagcaaataaagagcacgaacaacaagaaacagacgagacagaaacgcaaacaaacgacggagcagaacaaagcagcagaacaagcacgaccgagcaacacaaagaaaaccagcaacaaacacgccn

SEQ ID NO: 466362 - DNA, 1701 bp, Homo sapiens
ggctcctgccataacccaggtgccagccggtctccgcctaggaccttccctcccgcccagccagggtgggcggcatcctacgcggtgaaacgagctcatggactgacccggggctgggcctcgccagccaggagagagcgagggccgcacggcagggctggcccaggcagctcgtccagggccattcagatcccaagcatcaggaaatcattttgtacaaccacccgaagcagagatattttttaagaagcgtaaattattttcagttgttttctgatcctgcctttttcttttccccacaacttcacgccagtgattcgttcacatcaggtaaatcttgagaaagccttggtgccctcctccccaccccccactcagtaaccacgtgcgtgcacccccgcatcctttctcagtagttaagacgttctaggcaataccatagacacatctgactgtgtctctctctttgagtgcaagaaactcaagtcatcttaaaaaaaaaaaaaatacaaaaaaaatttacaaaaaaacaaacacaaaaaaaatatcttttttaggccagagttttctacaggtattaatgaatatttttcttaatccttataagttttatgtgtttaatatttcttaataccggtagcattaatttatacttttgtagcaacacaatatttttataaacagccggtgcttggctcaagtcttcacgaggggtttaggcagggccatcttggggaccctgtgtaccatgtactgtatttaaaaaaaaaaaaagttacctattgtcacacttgctgtgttaattaacaaaagatgttgtgtgcggtctcctgtatcggtgtggatccaacagctctccagggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttaggaagatgcagcgtatggtgttttttttcttgggtttgaggatgggccatactgtccagttaggagcagagcacctgcagggcccaggtgagtggagatgggccagagacagggcacctggggtgacagcacacatccatcccagcgggacactgtgtgatgctggcatcgttgacttaactgtggtgatggtggtatcagtgacttacctgtgagctcgcagctcatctcttgcaccagacctggctcagccagtgtttgataaatgagggagggacatggtcgaggaagatgtgaccctcctgggcttgtggagcattgtccca

SEQ ID NO: 466363 - DNA, 902 bp, Homo sapiens
ggctcctgccataacccaggtgccagccggtctccgcctaggaccttccctcccgcccagccagggtgggcggcatcctacgcggtgaaacgagctcatggactgacccggggctgggcctcgccagccaggagagagcgagggccgcacggcagggctggcccaggcagctcgtccagggccattcagatcccaagcatcaggaaatcattttgtacaaccacccgaagcagagatattttttaagaagcgtaaattattttcagttgttttctgatcctgcctttttcttttccccacaacttcacacttgctgtgttaattaacaaaagatgttgtgtgcggtctcctgtatcggtgtggatccaacagctctccagggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttaggaagatg

SEQ ID NO: 466364 - DNA, 1219 bp, Homo sapiens
  misc_feature (1219)..(1219): n is a, c, g, or t
gttactcttagcatgaactgaggttgtggtgctgtgagggaacactgtggttacagttgagcctgggctgctgctgtagacggtggtagattcctcactgaggcctggcgtggtggtgctggcaggtgacactgttgagtgagtagaacctgcttggctacgggaggtggtggattcttcaccgacgcccaggcttgtcatgctggcagttgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttaggaagatggcaaaaaaaaaaaaaaaaaaaaaaaaaaaaaaaaaaaaaaaaaaaaaaaaaaaaaagggggggggggaaaaaaaataccccgggggggcccaaatgggcaccgtttttgttgaaaggggggccccaaaaagggggggaaaaaaagaggggggggggcgggtaaaaacggggggggggggaacacagcctgcacccggggcgacccctgtgtggggaggagaccccacaacgtcgcggccgccggggaccacatcggtgcggacaacccccccaaggagaaattaagacgagcccagaggcaacaaataaacctgcgcgagcgtcactggtgggtaaccccccaccagctaatagtcggcgccacggaaaaaatgcgcccccggactactcttttcgaacacactttacgacgccgacacacaatacgcaaaagacactaacccccgaagcacacagacagagaggagagacacacgacgagcaaatcgacagaccacaaaagcaggtagaccacgaagaaacgacaacaacacaaggaaaaaacaaaaacacaacacgagaaagcagcgaaaccaagagcgcacaaagacagcaagagaaagcaaataaagagcacgaacaacaagaaacagacgagacagaaacgcaaacaaacgacggagcagaacaaagcagcagaacaagcacgaccgagcaacacaaagaaaaccagcaacaaacacgccn

SEQ ID NO: 466365 - DNA, 784 bp, Homo sapiens
agcttttctgaaactgttcctcatagaaaatcctttcttaaatggatgtatgtctttcacctttccaaaaagaattggaagtggctgaaaacaaagaaatcgttgcatgtattttagacagttatttccttttaaaacttctccttccttgccctctttgtaggaatgatccagagaaactagacgccttcatcatggacaaagcccttctggattatgaagtgtcaatagatgctgactgcaaacttctcactgtggggaagccatttgccatagaaggatacggcattggcctcccacccaactctccattgaccgccaacatatccgagctaatcagtcaatacaagtcacatgggtttatggatatgctccatgacaagtggtacagggtggttccctgtggcaagagaagttttgctgtcacggagctcagtgtctgagtgggaaaaagtgaagatgctttatacaaaccattagactgcacttaaaacagatctttacggaaacaatggatcaaatacttcttgaagaaagaaaaaagtcttcctctattgttcccagcaagaagtaatttctcaattctctgagttcttatagttcttttcccttacctctctgatgacatgttttgttgtccatcttgtattattaattataattctttaatgcctcaattcactcactgatcagcaagctttctgagcaaagaccatctctgaatgtcccaatgctttacatgttaaaacatgattgaataaatgatgccctataaagaataatt

SEQ ID NO: 466366 - DNA, 885 bp, Homo sapiens
cagagaatggatttatgcatctgcaagtcaggaaggccaaagatgaccacaaaccaccaggagctaggaagaggcaagcaagggttgccctacaggtttcaaagggagcatgaccctgccaactccttgatttcagacttctagcctcccgaactaggggacaataaatgtctgttgtttaagccaccccgtttgtgctgcttcattacaacagctcttgcaaaataattaatacactccacattttacttctagtgcctcttgcatcccagctcaggctcttctagacaagcatttgtagatgtcattgtttcctagctgctctcccagatactggtctcttgtcctattcaatctacccataatgccagattaatctctccaaaatataattgtgattaagttgttcttttgataaaacgtgtgctttccctactgggtagagactaaatgtcttagccaaacattcaaaaccctgcttcatctggttctgtctagctcatcttctgctactttgctcaagtacttcagccattataagcaacttgctaatatctacacctgtactctttcccacttctgtgattatggtacttgttcccttttctccctcaggatcaaatacttcttgaagaaagaaaaaagtcttcctctattgttcccagcaagaagtaatttctcaattctctgagttcttatagttcttttcccttacctctctgatgacatgttttgttgtccatcttgtattattaattataattctttaatgcctcaattcactcactgatcagcaagctttctgagcaaagaccatctctgaatgtcccaatgctttacatgttaaaacatgattgaataaatgatgccctataaagaataatt

SEQ ID NO: 466367 - DNA, 1251 bp, Homo sapiens
cggggtcctgcttaaagaagcagtctggccacgttttggtaaagcagccatgctgtgctggggggaacctacctcactgcgaccatttggactcttcaaagccctctggctggaatgtcttgagttgactgaaaaggggatggtggcccacccctccctgctggggttctgtcctgtgtcaggcagaccgcatcttgttgccagtggctggctagaattccaagccagtgagttctatcttgtgaggtgctgtggaagtggggcccgcggaccaacactgcttaggcccctgggttcagctcccttcttaggggtatatatggacctcccaccttgtctgagctgcagacatcttttccgggggtcctggggctggaatgtaaaactcctgagtctctgtgcatgcctgagaagctgctctgctgagattccacacagctgtgtatgtcagacccaaggcactggtggtgtgggcccacaggtggacctcctgatctgcgggttgcaaagatcaatgggagaagcatgaacttctgggaattctatcctatgacgatcatggcatggaaagtaaaaatgactgtatgtgtcagtgtcagagaggcctaaggaactttcaccaagtctcctacagaacagagaagagaggctatgatttccttatgttcctgagaaaggcaaagcatttgtctgaaagcgaaagccaggagatcaaagtaacttccctgtcacaagaggaaacatgagagcagaattcagcatgagttttgtatatggcaatcaagtatattcatggctatctaaatgaatgtccacgtagaagtcaggcagcacaaagaacaagatataacagctgaacgtcccactgaaaaccagctaagtgttgatcacaaccatcaaaaaaattcttgtctttacttacagtgtgactgtaactttcagaaagtaacacatcagtaaaatgcaggtatatcattctgccttcaaaaaggaagaggagcaagtattttcaagggcaggcactgcttttttattctggaaccctagagattcagaccaggaaacctgttaggatgagggcttttaaggaggcaggaagagagaagctgtgacttgaaaacagatgaatccagaagtcacacacacaactgttcatcacctaagctggatataagataattttttatagtatttcattcttcttttcattacattgtagtgtccttaagtaaatccattagcttgtttggg

SEQ ID NO: 466368 - DNA, 1264 bp, Homo sapiens
cggggtcctgcttaaagaagcagtctggccacgttttggtaaagcagccatgctgtgctggggggaacctacctcactgcgaccatttggactcttcaaagccctctggctggaatgtcttgagttgactgaaaaggggatggtggcccacccctccctgctggggttctgtcctgtgtcaggcagaccgcatcttgttgccagtggctggctagaattccaagccagtgagttctatcttgtgaggtgctgtggaagtggggcccgcggaccaacactgcttaggcccctgggttcagctcccttcttaggggtatatatggacctcccaccttgtctgagctgcagacatcttttccgggggtcctggggctggaatgtaaaactcctgagtctctgtgcatgcctgagaagctgctctgctgagattccacacagctgtgtatgtcagacccaaggcactggtggtgtgggcccacaggtggacctcctgatctgcgggttgcaaagatcaatgggagaagcatgaacttctgggaattctatcctatgacgatcatggcatggaaagtaaaaatgactgtatgtgtcagtgtcagagaggcctaaggaactttcaccaagtctcctacagaacagagaagagaggctatgatttccttatgttcctgagaaaggcaaagcatttgtctgaaagcgaaagccaggagatcaaagtaacttccctgtcacaagaggaaacatgagagcagaattcagcatgagttttgtatatggcaatcaagtatattcatggctatctaaatgaatgtccacgtagaagtcaggcagcacaaagaacaagatataacagctgaacgtcccactgaaaaccagctaagtgttgatcacaaccatcaaaaaaattcttgtctttacttacagtgtgactgtaactttcagaaagtaacacatcagtaaaatgcagctactttgactcgaagataacagccatactgttcacagtgaggtccacagaccagcagcttcatcattgtcatgtgaggatgtgtcagaaatgcagaacctcaggctccacctcagacctactatggaatcagaatcttcaccttattaagatccccaggggactgggtgcagtggctcatacctgtaatcccagcactttgggaagccaaggcaagtggatcacttcaggtcaggagttcgagatgagcctggccaacatggtgaaaccccatctctactaaaaatacaaaaatta

SEQ ID NO: 466369 - DNA, 5138 bp, Homo sapiens
  misc_feature (2)..(2): n is a, c, g, or t
  misc_feature (4)..(4): n is a, c, g, or t
  misc_feature (8)..(9): n is a, c, g, or t
  misc_feature (11)..(11): n is a, c, g, or t
anantaanntnttttcgactaccatggctgcaggagtcttgcctcagaatgaacaaccatattctaccttggtgaataacagcgagtgtgttgcaaacatgaaagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcaggcatttggagtattagaaaaactttccagttatcttccctatgtcaaatttcaggactcggggcttattgttaaatcctacataggatgctaaaaagatatttcaaagaagtacatatgccccatttaccagctttcaagcacctttattttatttttgcagacttcgaagctcaaagcttttccttttccttagaccccaggttaatgtataaatgttcccttatttctactttctcatctaccatctactttattgcaaaaaaatagttctgttttgttcaccagaaggctgaaaaggaagactcttgtgaactgtttctgtggtttctgaataaagtagagaacttggattaactaagccctttccctgtgctataagctttaaccgaccttatctcagtcaatcagcccaacagcttgtgaagcaggggatgagtttcatagagagaaactggggcttacagaattcagtgtcttagtccagtgtccagcctggaagtggagaggctgggaggggtcccagttctgcactctggagcctgagtctttcactcttgtgggcagcgcaagaatcatgcagtgtcaaatggtgcacctccctctcctctccctgtctctgtctctgtctgtctgtctctttctcttcctttttagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaaccca

SEQ ID NO: 466370 - DNA, 4482 bp, Homo sapiens
  misc_feature (2)..(2): n is a, c, g, or t
  misc_feature (4)..(4): n is a, c, g, or t
  misc_feature (8)..(9): n is a, c, g, or t
  misc_feature (11)..(11): n is a, c, g, or t
anantaanntnttttcgactaccatggctgcaggagtcttgcctcagaatgaacaaccatattctaccttggtgaataacagcgagtgtgttgcaaacatgaaagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaaccca

SEQ ID NO: 466371 - DNA, 462 bp, Homo sapiens
tgacaggcgagcagatgccgcagaagcactttttttattagagaaggtaaagtggctgtaggaccagttaatgactgtaactgaggcccttagtttttcacgcagaaaaaaaaaatccattataaaaaaagagaattcacacagaatcccaaatctagatctaatttaatagtttttccaagagaagagaagaaactgatacccagtgtaaacacttagaaaatacaaaaataaaaacgagaactatccatagtcctgggagaggcactgcaaacattttcaaacattttaaacttaccaatatgtatattaacttgttaaaaatcattttaacatacaagtttatatttcatttttgcttaaagttataacatagctattttcctgtgaataatgtaagcttttcataaatattgactcttaacggatatgatgctgtaacacgagactgtgccataatta

SEQ ID NO: 466372 - DNA, 5336 bp, Homo sapiens
  misc_feature (2)..(2): n is a, c, g, or t
  misc_feature (4)..(4): n is a, c, g, or t
  misc_feature (8)..(9): n is a, c, g, or t
  misc_feature (11)..(11): n is a, c, g, or t
anantaanntnttttcgactaccatggctgcaggagtcttgcctcagaatgaacaaccatattctaccttggtgaataacagcgagtgtgttgcaaacatgaaagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcaggcatttggagtattagaaaaactttccagttatcttccctatgtcaaatttcaggactcggggcttattgttaaatcctacataggatgctaaaaagatatttcaaagaagtacatatgccccatttaccagctttcaagcacctttattttatttttgcagacttcgaagctcaaagcttttccttttccttagaccccaggttaatgtataaatgttcccttatttctactttctcatctaccatctactttattgcaaaaaaatagttctgttttgttcaccagaaggctgaaaaggaagactcttgtgaactgtttctgtggtttctgaataaagtagagaacttggattaactaagccctttccctgtgctataagctttaaccgaccttatctcagtcaatcagcccaacagcttgtgaagcaggggatgagtttcatagagagaaactggggcttacagaattcagtgtcttagtccagtgtccagcctggaagtggagaggctgggaggggtcccagttctgcactctggagcctgagtctttcactcttgtgggcagcgcaagaatcatgcagtgtcaaatggtgcacctccctctcctctccctgtctctgtctctgtctgtctgtctctttctcttcctttttagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataatcctagtcctgtacttctttaccttgatgctctaggacatctgatgataaagacaaggttttgtcttagattatcctaataggcagattgagttgtcggctgattcagtgagccaagctctagttagtgcagactccttccatcagttcagcatgaccaaacactggggggttgggataggtgagttctaagagg

SEQ ID NO: 466373 - DNA, 5083 bp, Homo sapiens
  misc_feature (2)..(2): n is a, c, g, or t
  misc_feature (4)..(4): n is a, c, g, or t
  misc_feature (8)..(9): n is a, c, g, or t
  misc_feature (11)..(11): n is a, c, g, or t
anantaanntnttttcgactaccatggctgcaggagtcttgcctcagaatgaacaaccatattctaccttggtgaataacagcgagtgtgttgcaaacatgaaagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcaggcatttggagtattagaaaaactttccagttatcttccctatgtcaaatttcaggactcggggcttattgttaaatcctacataggatgctaaaaagatatttcaaagaagtacatatgccccatttaccagctttcaagcacctttattttatttttgcagacttcgaagctcaaagcttttccttttccttagaccccaggttaatgtataaatgttcccttatttctactttctcatctaccatctactttattgcaaaaaaatagttctgttttgttcaccagaaggctgaaaaggaagactcttgtgaactgtttctgtggtttctgaataaagtagagaacttggattaactaagccctttccctgtgctataagctttaaccgaccttatctcagtcaatcagcccaacagcttgtgaagcaggggatgagtttcatagagagaaactggggcttacagaattcagtgtcttagtccagtgtccagcctggaagtggagaggctgggaggggtcccagttctgcactctggagcctgagtctttcactcttgtgggcagcgcaagaatcatgcagtgtcaaatggtgcacctccctctcctctccctgtctctgtctctgtctgtctgtctctttctcttcctttttagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtatgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaaccca

SEQ ID NO: 466374 - DNA, 896 bp, Homo sapiens
ccccagcatctattctactccagatgatacgccaatcatgggaaccccttccttctgctgtgcttgcagaaggaattcaaattgttaaatcccttattacaggctcctattcttcatcatccatccttcaggttctcatgtcccatctcaacttccttctgcaattctccttgatttatagctcagctgaagctccaaagccagccatgcccacagtaggacacttcctgccaacccttacatcattgacatttggccttttctgcctaaacaagttgtggtattatggccacaatttcgagggctgcagagtattgacggagaaaagagagaacaggttgaacattaataaggaggagctttggcactggtccaagaaacaggataagctaaatctctgcatctattctggacaccagaatggcgcggggaccatttagaggtgagatgggcagatgaggagctgaagtttcagagaggttaagcaatttgcctaggttcacacagcaaagatgatgaaacttacaaccacaaggtgagcccttcttactagaagttctcttcgtgtctcctggtgttcacatattggaagacttaatccttcagtgaccgggaaaagacctcctaggacctaccaatccagccttatcagacacctggcagagaaagtgatttctgaagcaggagaaaacccaggaagattgctcagttcctgtgcaagctgcttcccagctggagatgacagttaatcttgaaaatcaattcagtgcctgctctcactgcagacactcctcagggcaggccacggctcctctcaccaccgttaaacagaataaaaagtggggaattgagcagcataagacatgcagtggctgccagtgggaagcggtcaggag

SEQ ID NO: 466375 - DNA, 2587 bp, Homo sapiens
gacagacagagggacagacgtggctctgcaggtccactcggtccctggcaccggccgcaggggtggcagaacgggagtgtgaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaaggcacctgctgcacagggacaggggaccggctggagacagggccaggcggggcgtctggggtcaccagccgctcccccatctcagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgtcggtgtctttctttgctcccaaggctaagctgcaggatctgcctggc

SEQ ID NO: 466376 - DNA, 1380 bp, Homo sapiens
  misc_feature (54)..(54): n is a, c, g, or t
  misc_feature (57)..(57): n is a, c, g, or t
  misc_feature (100)..(100): n is a, c, g, or t
  misc_feature (104)..(104): n is a, c, g, or t
ccccgcaagacggggggcgcaccgtgtcgctcgccgggcggcgggaggggaganacntacggtaagaaaggagtttgtgaaagcgtcttgcgggggctgnccgnagcccccgcaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgtcggtgtctttctttgctcccaaggctaagctgcaggatctgcctggc

SEQ ID NO: 466377 - DNA, 810 bp, Homo sapiens
ttttgaacctaaatattctcattgcaaaatgggagtaatcatactccacccacagagttgctacaagatgagaaatgaaggactccttattcggggcaaactcactcccactgtcagctggcgggtcccagaccacctgtatctgagcagtgtgaagaagaagaggcaagaacaacccctggaccgaccaaagccctgtgcccttgcatcccatacccagcacccacatcctgctgccattgtcaccaccatgcccaagagaaagggtgaaggggatgctaaaggagataaatccaaagttaaggacgaaccacagagaaaatccacgaagttgtctgctaaacctgctcctccaaagccagagcccaagcttaaaaaggcccctgcaaagaagggagagaagacgtccttcacttccaggatccagtccaaactcctgggcttggcacatgaaccctccatcatctggcacctggcagcccacatgctggagcctcacggatttgctcatcgccctctgaacacctgtggccttctcactcctctgtgtctttgcacatcctttccccaacctcatgccaggccattgcattgtgatccaggctcagtcttcgttctgcttcgtggcatcacagtcccttatttgaaactgaaccaggactgcagtcttcgactttgacatcaaatttgacacctcagtggcccaagctttcagaaacttggaattgcagacattatggatttggacctgccctcagaaggttactatgaggactaaatacattcaaagtacatgcaagtactttttag

SEQ ID NO: 466378 - DNA, 1300 bp, Homo sapiens
ttttgaacctaaatattctcattgcaaaatgggagtaatcatactccacccacagagttgctacaagatgagaaatgaaggactccttattcggggcaaactcactcccactgtcagctggcgggtcccagaccacctgtatctgagcagtgtgaagaagaagaggcaagaacaacccctggaccgaccaaagccctgtgcccttgcatcccatacccagcacccacatcctgctgccattgtcaccaccatgcccaagagaaagggtgaaggggatgctaaaggagataaatccaaagttaaggacgaaccacagagaaaatccacgaagttgtctgctaaacctgctcctccaaagccagagcccaagcttaaaaaggcccctgcaaagaagggagagaagacgtccttcacttccaggatccagtccaaactcctgggcttggcacatgaaccctccatcatctggcacctggcagcccacatgctggagcctcacggatttgctcatcgccctctgaacacctgtggccttctcactcctctgtgtctttgcacatcctttccccaacctcatgccaggccattgcattgtgatccaggctcagtcttcgttctgcttcgtggcatcacagtcccttatttgaaactgaaccaggactgcagtcttcgactttgacatcaaatttgacacctcagtggcccaagctttcagaaacttggaattgcagacattatggatttggacctgccctcagaagagctacctactgaaatatttacaagtgaaatgatgtgagatgtgggatttgattcaaaatgatcctttatgtatgaagagtggggcgtggagaatgcatgaagatacagataaaataaacgtgtctatgggttaatacatgctgtagctgggtacatggtggtttattatgctattctttctagttttgtgtgcatctgaaattttccataataaatactttttagaaaactcatgaaccgttctgattcctggagatgccttggtgcgcatgaccatataatccttctttgaagggtgacttcggaatcaatcaacttaggtttgccacctggctgtcacttggtagctgtgtagctctaccctgactgacctcagttatcccatttgtaaaattgcaaaagtgcctcatacgagcacttagcacagggtgagacactggacttgtaaatgatagctcaattttcttggtccagaacataactttatgaaaacagcagtatttgtttagtaggctgtttctgcttctataacatgtgt

SEQ ID NO: 466379 - DNA, 3252 bp, Homo sapiens
gagaaatctggaatccagatacggcagaatcctgctgccttcaacttctaatgtgaccacagactcctggaggcccagtgagaaggagcccggtctgtcctagtcctcacatccttcagctcctgccagcccaatcagattagtatctggttcctctaagtcctcgtgtttgtccctgtcctaaattttcctggtgcatgacgacaaaccccgggcctcctgaattgctggcaccggctgtggtcgacagacagagggacagacgtggctctgcaggtccactcggtccctggcaccggccgcaggggtggcagaacgggagtgtggttggtgtgggaagcacaggccccagtgtctcctgggggactgttgggtgggaaggctctggctgccctcaccctgttcccatcactgcagagggctgtgcggtggctggagctgccaccgagcgtctcggatgcatcaggctggatggtgacatctccccacccttgaatgagacggctttgtgctgctctgggacccgcacccagcttggactgcttgctccatggccccaggaaaagctcgtacagataagtgacaccaagccctgtgaacaaaccagaaggcagggcactgtgcaccctgcccggccccaccatcccccttaccacccgccaccttgccacctgcctctgctcccagatctggaaacttcgggccaggctgagaaagagcccagcacagccccgcagcagatcccgggcactcacgctcatttctatggggacaggcccagcaaagagagagaggagagggaggggctgccgctgaagaggacagatctggccctagacagtggctctcagcctggggacgtgtggcagggcctggagacatctgtgattgtcacagctggggagggggtgctcctggcacctcaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatagagatgagatccagtacatctttggggagccctttgccaccccactccgggctaccggccccaagacaggacaggaccccaacatgggccactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccagtgactctgaggctcccccgtaccccctacgggtgactctgaggcccgtgcccaccttgggtgacactgaggctgcccctgtgtcccccacagatgactccgaggaagctcagatgctgcagtcattagtttctagtgctaagctgcaggaaggagtggacctcagttacccttacagcaccaggtgggaggataaggctcagggccgacaagtcctgtggcctcatgcagcagagctgagccgggacgaaccctgtcccctggagaagcaggggacaccctggctggctgtgaccactttggccaccctgggcttcctggggggctgcgagctctaaaggctcagggcccagctacccctttaggatgggtcagtaacaacacgactgactctgtaaattggtgatcacctgagactggacctcagcaccacacggacctgtgcttcaccttggccatcgggggagagtatggaggtcttttgctggcaggaatcagcacccttatcctggcaatcagcactcactggccattcatgaggctccagcaggacgagtggccacagtgtgcagggcacaggggatggggctttccaaggtgtttctggatgacatcaatcacacaaggagttgtaggaatgctggcatcctggttcacgggtagacgccagaggatgccaagggtgctgggtagaaagcagaggatgccaagggtgctgggtggtgggccccttgggggtgcccaatggctctggcagagttgttggggcagagtcgggaccacccccacctcttccgggtccaagcccaggcactgcactgagcacttgatgagcctgacctcaccatggccttgtgacgtgggcactgtgggcaggaatgcttatggaatgaggcccactgtaaccctaacacagcatcacaagtctttccccagagagaaaacgcacaggcaatggaaatctatggttaggaacaaagattcccgtctaagaaaaagggtggaccacgggcctctagaagggactgagggggcaaagtcctgcccgtgcactggctaacactcttcctttagcttttcccccccactttccatattgtacattttatctgtttataatttttcttagtgctgactaaattccagagttagaccttgaaatccacaagttcctaattggtggtcaacagaaacctcagcaagacaagcagaaaatgctcctcttcccctaaagctgtagaaaggcagccaccaacctgggctaggaaatggtccttacagatactattttttttttaactgtggtaaaacctatataacaaaactgatgctaatttaactgtttttaagagtagaattgagtgacattagttcgattcactgttgggcaaccatcaccactctctatttccataattttttcatcaccccaaatagaagctctatatccattagctaactcctcatttcccctccctctaacccctggtagcctctatcctttctgtctccatgaatttgccttttggagatatttctcataagtggaattgtaatgttttcaaagttcatccatgttgtagcatgtgtgggcat

SEQ ID NO: 466380 - DNA, 878 bp, Homo sapiens
cagttaggcacataactgtgactgtcctgctggagagggaggccacaagcaggggacctggaagatgaggggccacatggagagtgaggcctcagagaggagtgcggaggttctggacatgtgaatgaaggtgccaccttggacgttccagacccgtcgaggctccaaggacaccagacccatccatcgtgtgataagagccaacaagagcccccagcagaacagcatggcgtccctccaccccagggctcacactggggagggcctgctggatgggagtgaggttagcaggacagggataagacagatgaagaaaagaaagggcccagacacaagtgaggaggggacaaagggagagcattttgaacgtgtgtccggagtgtgggatggagagaagaaaggagaggggaaaagggaaaagggaggggagaagagaggaggagggatagggcttcatgagagccagattgcagtgactgttattgcccttctgggtctagccacctaccagggctactgggctccaggctggtgctggggaatgtcagcagagtcctgtgatgtgattcatcttcaagtctttcagtcatggataccagcacctgttctggtggaggtggcaggggagtgaagtggactctgtggaagtccttggttgtagttttgtttagcacacaggttttctcaaatactggttatgctagcagtgaagttgtcacatggacagactcaggacctctggttagccagggtgttgcaggcagagaaattagctgttgttttctccttctttgtaacagcgttgttctgttatgagttgctgtaatctcaaactttttatgtgaaatggttgtaccattttatattctcattagcag

SEQ ID NO: 466381 - DNA, 1227 bp, Homo sapiens
tagctgggagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggccgtttgaagaagagtgcagatacactttgggggatccaaaaggagctgcaattaaaagcctcagagtgtattcactatggggaggacacacagagcaagacagggggagcaggtatgcccataccacacggagaaccaactttcagagagggaaaaacacccgcggacaaaaggagcgc

SEQ ID NO: 466382 - DNA, 1261 bp, Homo sapiens
tagctgggagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggccgtttgaagacgaagccgaaaccctgggggattccaaaggaagggcacattaaagagctccgaggcacatcaatgcagggcgtagcgaaaccagcaatactacgggaagctggcacgtttgtcccctaatcagagcgggagaaaacgaggaatttgcgatggcggggaacaacacagccgagtagaaaaaaagggaggacacacgagaacgaa

SEQ ID NO: 466383 - DNA, 1217 bp, Homo sapiens
aaaaaaatcggctagtcgaggcggcgtgtaatcggcagaggcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggccgtttgaagaagagtgcagatacactttgggggatccaaaaggagctgcaattaaaagcctcagagtgtattcactatggggaggacacacagagcaagacagggggagcaggtatgcccataccacacggagaaccaactttcagagagggaaaaacacccgcggacaaaaggagcgc

SEQ ID NO: 466384 - DNA, 1226 bp, Homo sapiens
gattaaccccaagtggggctaataaacgcggatgggtgaaccctcaggaggctatacttacacccaaacgtcgatattccttttccacgctaattccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggccgtttgaagaagagtgcagatacactttgggggatccaaaaggagctgcaattaaaagcctcagagtgtattcactatggggaggacacacagagcaagacagggggagcaggtatgcccataccacacggagaaccaactttcagagagggaaaaacacccgcggacaaaaggagcgc

SEQ ID NO: 466385 - DNA, 1364 bp, Homo sapiens
aaaaaaatcggctagtcgaggcggcgtgtaatcggcagaggcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggccgtttgaagaagagtgcagatacactttgggggatccaaaaggagctgcaattttaaagtcttctgatgtcatatcattttactgtctaggctacaacaggattctagttggaggttgtacatgctgtcctttttatctgatctgtgattaaagcagtaatattttaagatggactgggaaaaacatcaactcctcaagttagaaataggaatgatttgtaaaatccacagctatatcctgatgctggatggtattaatcttgtgtagtcctaaactggtaagatattcacaacctgggcaattttgaaaatcagttggggaataaaattgtctattatgctgtgtttcttaactgtcattattaaggctttatttcttgccttttcaggattaatatatgactcacacattgtcactatatttatttaataataactgtgttt

SEQ ID NO: 466386 - DNA, 1438 bp, Homo sapiens
gattaaccccaagtggggctaataaacgcggatgggtgaaccctcaggaggctatacttacacccaaacgtcgatattccttttccacgctaattccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccactgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggccgtttgaagaagagtgcagatacactttgggggatccaaaaggagctgcaattttaaagtcttctgatgtcatatcattttactgtctaggctacaacaggattctagttggaggttgtacatgctgtcctttttatctgatctgtgattaaagcagtaatattttaagatggactgggaaaaacatcaactcctcaagttagaaataggaatgatttgtaaaatccacagctatatcctgatgctggatggtattaatcttgtgtagtcctaaactggtaagatattcacaacctgggcaattttgaaaatcagttggggaataaaattgtctattatgctgtgtttcttaactgtcattattaaggctttatttcttgccttttcaggattaatatatgactcacacattgtcactatatttatttaataataactgtgttt

SEQ ID NO: 466387 - DNA, 1367 bp, Homo sapiens
tagctgggagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagaggtctttacggaataaaggatgatgtcttccttagtgttccttgcattttgggacagaatggaatctcagaccttgtgaaggtgactctgacttctgaggaagaggccgtttgaagaagagtgcagatacactttgggggatccaaaaggagctgcaattttaaagtcttctgatgtcatatcattttactgtctaggctacaacaggattctagttggaggttgtacatgctgtcctttttatctgatctgtgattaaagcagtaatattttaagatggactgggaaaaacatcaactcctcaagttagaaataggaatgatttgtaaaatccacagctatatcctgatgctggatggtattaatcttgtgtagtcctaaactggtaagatattcacaacctgggcaattttgaaaatcagttggggaataaaattgtctattatgctgtgtttcttaactgtcattattaaggctttatttcttgccttttcaggattaatatatgactcacacattgtcactatatttatttaataataactgtgttt

SEQ ID NO: 466388 - DNA, 1243 bp, Homo sapiens
ttcggctagtacgagcgcgggttgatcggcagagggcgtgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggccgtttgaagaagagtgcagatacactttgggggatccaaaaggagctgcaattaaaagcctcagagtgtattcactatggggaggacacacagagcaagacagggggagcaggtatgcccataccacacggagaaccaactttcagagagggaaaaacacccgcggacaaaaggagcgc

SEQ ID NO: 466389 - DNA, 1159 bp, Homo sapiens
ggacgcgtgggtcgacccacgcgtcgttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggccgtttgaagaagagtgcagatacactttgggggatccaaaaggagctgcaattaaaagcctcagagtgtattcactatggggaggacacacagagcaagacagggggagcaggtatgcccataccacacggagaaccaactttcagagagggaaaaacacccgcggacaaaaggagcgc

SEQ ID NO: 466390 - DNA, 1192 bp, Homo sapiens
tagctgggagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagaaggccgtttgaagaagagtgcagatacactttgggggatccaaaaggagctgcaattttaaagtcttctgatgtcatatcattttactgtctaggctacaacaggattctagttggaggttgtacatgctgtcctttttatctgatctgtgattaaagcagtaatattttaagatggactgggaaaaacatcaactcctcaagttagaaataggaatgatttgtaaaatccacagctatatcctgatgctggatggtattaatcttgtgtagtcctaaactggtaagatattcacaacctgggcaattttgaaaatcagttggggaataaaattgtctattatgctgtgtttcttaactgtcattattaaggctttatttcttgccttttcaggattaatatatgactcacacattgtcactatatttatttaataataactgtgttt

SEQ ID NO: 466391 - DNA, 1131 bp, Homo sapiens
tctgtgcgctcgaacttggctccgccaagaagctgggcaaggatccgggctcctgatggaactggcaagttggaaaagtggcaaaggaaaagccaacatgagcgctttcggcttgcgcgggcagaaaggagagtcactgagtgaccaaagcagttgggaaacagaggcagaggactgcccccactctgtccgcagcaggggtatgggaggcagctcgggacactccagggaccaagcgggcagtgggcgccgtccccgaggaacacccagcccagcgcccctggttctgggctggttggcttatcgaggccggttggccaaagcatcaggaaagggaacattctcggccgggtgttggataccaaattataaacgccagagcaccttgtgtaaagatgaatatcgttttgttactgcgggagggaatacacctactgctttgaaaggagtttaaaatattcagcagacagcaccgcattgaaattagtgcattgagctgcagaccaaactaatttctagaacagtctaaaaagtaaaaacaaagtttggcaaaaatgacaactttgcttgagaacagctctggaaaagcgaatccactgagagccgtgggaattctccgccagctgtgcttccccaaccgaggaagaatccaacccggaatatcgtttctggaccccaccgcggagaccccagctggaccctctcctgaaaactgcccggggaggggggtgcggtctcagcgccctccactgcggggtccaaggcgcagtagcggggcgcgaccccagcgctccaagcccagcattcttggcagctctccaggccccagtcagaggcacattgaccttgaagttgcacttgactcgcccactcggggctgcctggtggcgcctgggtcagcttgaaacccacgcagctgagggagctaggtgtggggttcaccatactgcgcccccgccggatttgggagcgcgggatctactcggaggcagagagattagccccagaggtcaagcctttcggcgtcgttttgtcatctgtattttctcgtccccttcgccgccgagtcctacaaagctcacttcagagagactgggtccacatgtgtgggctcatgaggaggaggacagc

SEQ ID NO: 466392 - DNA, 8423 bp, Homo sapiens
  misc_feature (2)..(2): n is a, c, g, or t
  misc_feature (9)..(9): n is a, c, g, or t
  misc_feature (11)..(11): n is a, c, g, or t
  misc_feature (13)..(13): n is a, c, g, or t
  misc_feature (15)..(15): n is a, c, g, or t
tnctgcttntncnanaggttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatggcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaagggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtga

SEQ ID NO: 466393 - DNA, 2976 bp, Homo sapiens
attgtatttaagtaaaagcaatagggtttcagaccacagtagaaaagattaggaggtctctaagcaatgcagaaagaattagagaaagaagctcaggatagtagggttttgacagtaccgactggaaaatgttaagaacgaatgctggttggaaggaatgaaccatgtaatttagtagtagcaaaacaaggagaataataaggaatttaagcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaagggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtga

SEQ ID NO: 466394 - DNA, 2482 bp, Homo sapiens
aggcactaagctaaagcagaagcttggatgagtaagaaggccccactcatggttcacacctgctgctatgttacctggagcctcagtcaccttttctgtaaaatggggctgagaacaggagattgatcggatggcgttagatttggcaaatgcaggcattttaaaaatgagaattggaggaattgctatgatttacccaaagtttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtga

SEQ ID NO: 466395 - DNA, 2148 bp, Homo sapiens
caccggcaggttgtactccaccggcaggttgtactccaccggcaggttgtactccaccggcaggttgtactccaccggcaggttgtactccaccggcaggttgtactccaccggcaggttgtactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtga

SEQ ID NO: 466396 - DNA, 1692 bp, Homo sapiens
ggtgacttagaggatcccgctggactcgtcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtga

SEQ ID NO: 466397 - DNA, 7246 bp, Homo sapiens
  misc_feature (2)..(2): n is a, c, g, or t
  misc_feature (9)..(9): n is a, c, g, or t
  misc_feature (11)..(11): n is a, c, g, or t
  misc_feature (13)..(13): n is a, c, g, or t
  misc_feature (15)..(15): n is a, c, g, or t
tnctgcttntncnanaggttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatggcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaagggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataagatgatttgcattataatgggaaaagcttgagctgtgtcatgtggagatctgagtcctaactaatcctggcttcatcacctacctgttttgtgatcttcatctacaaatatagaaggcaacacatttactgcacaatggtcgtaagggataagtgatacatgta

SEQ ID NO: 466398 - DNA, 423 bp, Homo sapiens
agaaagaagttactaccatttgacagtgttcagattcggttgagtgaccaagtttctgggtggtcaacaaacatgatgaacagatttttttttagccccacaagcaggagagccgcacttggacatatataacgggtttgccagcaggaaatgtgaaaatgcaatgatccctggttacacgcatcacctctcctcccaaactctctcctagatctgcttttactatgcacgtggaagctgggcactcagcagttcccgaggagggccccaaagatcttcgctgtcctctctgcctctatcacaccaaatacaagcgcaacatgattgaccacatcgtgctgcaccgaggtaacctttctaacttggttttcttggatgcagcggggggcaggcagcagagatggccttctagggatgctctct

SEQ ID NO: 466399 - DNA, 8923 bp, Homo sapiens
  misc_feature (2)..(2): n is a, c, g, or t
  misc_feature (9)..(9): n is a, c, g, or t
  misc_feature (11)..(11): n is a, c, g, or t
  misc_feature (13)..(13): n is a, c, g, or t
  misc_feature (15)..(15): n is a, c, g, or t
tnctgcttntncnanaggttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatggcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggttggaccttcctcatctttctgttcagggaaaggtcgagtttcgatctggtttccttccacgcggatagtttggtggcagcagaaggtccaggattctcggtctaggaggcttcggggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataagtttggtaatgaaggtccggtgtacaaaagttccggtgaaaatgatggaatgtgggagcaaagggctgctccatctccaaaagagtcaaaacgaagaaaaagacctcttaggccccggagttgtttggtcctggttgcaaaaccacagtcacaggaaaatgatgtaagccgtaactttgagctggttggacgggttaacttggatcagctggaacagatgaaggagaaaatggagagctccagcagcgatgatgaggacaaggaagaagaaatgaacagcaaggctgaagacagagtgaacaaagataaacctgtgtcaaaaaggaaatgaatagatgctagcctgtgaggcactgatataaatcatcacacaagggagagaataaatcggaaaaaataatgctcagattcctttggaatctcgggcaagcggctcttcagtcaagaaagacccagattttgtgatagaagcattggggaggtgaggcgaaatgaggtcttggggcccaagaaccagaaacagttctcgaatgctattcaaggaatgccctaagggggaaacctaagaaaaagtgaggaatctggaaattgctttcaccacatggctttatcagtgaaggtaggagagagggtatcctaatgaatgctgacttacctattctgctgattcccacagcacacaggtaacacttctgctttctctttgcagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtga

SEQ ID NO: 466400 - DNA, 4182 bp, Homo sapiens
gcctgtgagcatcttctcattgatccagagagacagctcttgacaatcttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaagggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtga

SEQ ID NO: 466401 - DNA, 2290 bp, Homo sapiens
aggcactaagctaaagcagaagcttggatgagtaagaaggccccactcatggttcacacctgctgctatgttacctggagcctcagtcaccttttctgtaaaatggggctgagaacaggagattgatcggatggcgttagatttggcaaatgcaggcattttaaaaatgagaattggaggaattgctatgatttacccaaagtttggatcgccatatgcaaacccaccacggacaccataaaccattccgatgcaaactctgctccttcaagtcctcctataacagccggctgaaaacacatatactcaaagctcatgctgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtga

SEQ ID NO: 466402 - DNA, 7565 bp, Homo sapiens
  misc_feature (2)..(2): n is a, c, g, or t
  misc_feature (9)..(9): n is a, c, g, or t
  misc_feature (11)..(11): n is a, c, g, or t
  misc_feature (13)..(13): n is a, c, g, or t
  misc_feature (15)..(15): n is a, c, g, or t
tnctgcttntncnanaggttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatggcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaagggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgaggtaacctttctaacttggttttcttggatgcagcggggggcaggcagcagagatggccttctagggatgctctctcagagtggcagtagcacctgtgccttgttcctcaccttatcttcaggcaagaaaccacagtgataaccacagtgacagccaaaagggcaaaaacaccttcctgctgggagtatttcctccacctggagggaggcaaaggtgatggattctgcagtgaacatttccgtagggcttcccagcatgggggatttgtacattctgacaattctgccacccacagccttgcgtagactgcatagaaggaatgaacaagaaacaaaatgggtgggtgaaagcaaatgtgaaatgtggagagctctatggctgtgagagattctttcaagaagaccaaaatgatttccaaagcagaacatggaacttcccttgaaatggttgaagggagagagaattctttaaaataatgtatattatacattctaataatagtctctattatatattctaataataattagaaaatccatgggctttggatttaaattctggttttagagcccactgtgtttaacctctccatccattaaaagagatgattgtacctatgagataatgggtaaagtgtccagtggtttttcataatggatgcataatgactgctcaataaatgttggttcctgctgataaacagtga

SEQ ID NO: 466403 - DNA, 7464 bp, Homo sapiens
  misc_feature (2)..(2): n is a, c, g, or t
  misc_feature (9)..(9): n is a, c, g, or t
  misc_feature (11)..(11): n is a, c, g, or t
  misc_feature (13)..(13): n is a, c, g, or t
  misc_feature (15)..(15): n is a, c, g, or t
tnctgcttntncnanaggttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatggcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaagggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggattcagaagtgagacgggatactctagagtcacct

SEQ ID NO: 466404 - DNA, 3203 bp, Homo sapiens
aacatttggctcctagttacttatgcaaatttctgcagctggcttgaatttctcctcagaaaatggtataatagatgacgcctggtggtttgggactgtggagagtcagcagccttttcaaccagagtatcctgatagttctttccagtgttacagtgttcagagaatatcagcattaatgtgggaggtacgctatattgaacataatgccaggactttcaatgagccagacagtcctatagttaaagcagctaaaattgtaactgatgtcttacttcgatttattggggatcagagctgtactgatatactggatacttataataaaattaaagcagaagaacgaaacagtactgatgcagaggaggatacagaaattgttgatttagattcagacggtcctggtacttcatctggaagaaaggattatcaagatgttatagatactcctgtggacttcagcactgtgaaagaaactttggaagcaggaaactatggtagtcctctggaattttataaggatgttcgccaaatattcaacaactccaaagcttatacctctaataaaaagtcaaggatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctagtccaaaagggaagcagaaacaaatgaagttgcagcctaaaaatgaccagaatacctcagtatctcatgccaggactagctctcctttctcatctcctgtttcagatgctgctgaagggctttcactatatctacttgatgatgagccagatgggccattttcttcatcgagcttcggtggatatagccgaagtggaaatagccatgacccagggaaagccaaatcatttcggaatagagttttgccagttaaacaagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaacagttaataaatttagaataacttaaaaaattcaatggccttctactgcagggaatttaccaggaaatctacaaagcaagttgtgtggggacttctgcttcctttcacattggtgcttttccatttatgccagtatacatttgtttcaagacttttgatctccacacttcatttgttcaaataagccttactcattaggccttaaattaaaagaaattctgcccacacacacacaaacacatacacacacatacacacacacagacacacacacacgaaacacaacacagacactacagatttactacattaaaggagcattcagcttcttaagagtagcatgacatttttatctcaatagaatagccctcttttgcttttgtatcacagaagtatagcaccttcttacagagttttatatagtttgtttttgccattttgattcctatacccagtaataataacttttgcacaatacaccaatcctaaaggcagctattaaatgtttacagtttctatattgtaagagcgatctggattattttactcttcccaggccaaactttcatgacttgtactgaactgaagtatatatttatactacagttttttggggggtggggggatcttgatatgcttttcattgatttgcataattcacgttaaaggtgagaaagggttggtgccttgtaaatatgtagcagatcttcgtggtgtgttctgatgtgtgcattaactttattaaaaaagaatacttgaggtatcaatctagacaaggtgccaaatgcaaaagtttcccgcatcaatttttttcctatcacattttattgcattaatagaatttgtgtagcttaaataacttaaacatttgaaaaatcctcatccacaaagaacaacttctttgaacagtagctcagctacctcttaactacaactactggaaacattaaggaaaatagatgctgttattccttactgactaaggagaaatagaacaagcttagtaggaatgaataccccataagttataagctgagaggttgttaataattgtattggctctcaaattaataattgtaattaacaaagtttcataaatatagtatgctctaccaccttaggctttcttagaacatatttgtaaatcaggcttgtgttggaattcttctctataatactttgtttcccgcagatgcaaagtaacaaagtaactgagtaaaattagaaatctcattctgcacaactgtgcgctcagatatttaactcagccttctaatacttttaacttatcctttctttatgcaccttcctagtctaacatacttccattggaggttcgattttcttataatctttaaaagctctgtatcctacttgttaaagttatttatttgaaggcaaatatcccatagaactgctttaggtttctgctttcataagaaagccttat

SEQ ID NO: 466405 - DNA, 159 bp, Homo sapiens
tcctaaactcttatgcctatgtagagttagtaatcaaaagtactatttatgtgggttttactatcccagaaactttttttaaattttaatgattgaagtttcactgtcaaattatctatttcatgaattttagggcatttcttctttggccagctaata

SEQ ID NO: 466406 - DNA, 725 bp, Homo sapiens
gtctgtaatgatgatgcttaatattggtctaggcatgtttatacctttttttaaaatataaaactagttaagactatataatttctgccttctcagatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctaggtatcattacattgatgcaacattttttgttctcaaagcattttgtatgtattacctaatttgtgaaagtttatgaataatttggggagatcccaagaggtctttttttgtttgtttcctaaactcttatgcctatgtagagttagtaatcaaaagtactatttatgtgggttttactatcccagaaactttttttaaattttaatgattgaagtttcactgtcaaattatctatttcatgaattttagggcatttcttctttggccagctaatacctgaccttgatacctctttgtatcatactgtctatcataatatgttgctaacagaaaaaaaaaaatgctcgttgttacatatttttacttctagtccaaaagggaagcagaaacaaatgaagttgcagcctaaaaatgaccagaatacctcagtatctcatgccaggactagctctcctttctcatctc

SEQ ID NO: 466407 - DNA, 444 bp, Homo sapiens
tttgagtgagaatggaagaaaatggtgagaagggaggaaggtttcaagcttgtcttatagcagactcggtcacagctgtgctgtctctctccccaagctcagactgggacatgtcacttctgttcacagtccattggccagaactaaatgcacttgtccaagcagtcacaaaaaaggctgagagaccaaggggagcccacggacaatcagtgccaaggcgtgttccatggtgcttactccaggagaagccagcttccatgttgtgcagatgctcaagcagtgcttggagaggctccttgtggaaaggagccgaggcctctgctgacaaccagcaccagacaattccattttctccaactgggagctgtgaaggatcaagtcctactttcttcattgatacggcaatatcaaataaatagtcataacactcacacatggttttgg

SEQ ID NO: 466408 - DNA, 2791 bp, Homo sapiens
tcttcttgcgtgactgatcgaccctatgaggcttttgtggttaaaatataaagttcctgaaaaaacctttccaaatctgaatgggattgcagtgacatcaaagcttttcctcttcaatacctttcatctttttcagactctggcactctccccaccagcttcaagtcaattaattgaaaagtcattagaaagctcctctgctgtgaaggcccacctcatcagctccatatctgggtccttcaagaaggaacagaagggccgttggcctccacattattggtgcttcgcccacctccaccctgttctggtctcagatgtttgtcctgtggccctagacatgaaatccctagccatttctcttagaaaatgcaagccatggtcacaaggaaaacctagaaaaggcagcgtgggcacaaaccatggcacagaagcagctgaaggagcctgctttcttgttggggaacgctggaatggagatagcacctctgaatcctcccaagtggatgatctggcaaagtccaagatacagaaattattctttcaaatagaggagtgcaggaaatccaatcctgaagatctccttccagttggctagcctgtgacccagaaatcactaccatgaatcaacgtgaaagtatgccaagccaccctgaggagccacatagaaaacaggtagatttgcaccacatctgatgcttttgctaccctggacatgagaaactgcttatatataacttggattatcctatccacccctgggagataaaaaggcattagagttttgaagaagattggtctttactttctttaagaaattctatttgttgaatgaatgtgtatatgaatgtaaaaatgaatcaatgaatgcatgaaactttaagtttataataggaaattaatcttggggtcaaatgagaaattatgaagatccattcttttcatggcatcccaaaactgtcacccttcaaaacaatttgcacagcctgctcatgaaggggtacatagcattttggaaggaatcagttctaattcacctttaaatatgttttttctcttaaaaatttattgtaagatatttcagacatattgtactaggcaagcctctaagggctcccccaatgatccctgcttcctggtattcatgttgttgtgtaaatccctccacttgagtgtcggctgtacctagtgactgacttccaatgaacaaaatacagcaaaagtgatgggatgtcacttttatgctctctggaaccagactgaaattgaaatgcaagatatatatatatatatatatatcacagaatctctgtcactaaatattctcccagaggcaaaggagctgggatatttacaccctgactctcatcattaagtggatggctcttggagggtatttgaactctctcacacatctggactgccaagaacacagacatgatgcttggagctatagcagccatctcgcaatcatgaggaaaggccaagagaatttctgagtcaccaaacccagcactgttcagctgctgagccaatccctacagcctcctatctctagaccttgtgctctgtgagaaaactaaaaccccattttgtttaatgccctcctgctccgagagttcaggttttctattccttacagtggaatgcatttcaaactgatataactgatccctcagccaaatactattcccagcagatggttagggttggctgtgtacagctatgcaaactgcacactccgggagacaccattcagaatgcctttggacttgtgtagtgcaaaacctgcattaagatgcaagctgttttctctggtgctgatatcagctgcccttctacctctgagaagatcatcctgagcttcctcttggagaataaatggtgcccatttctgtaagagactgtagcagcagctggcaccctgcgccctcacgcttctgctaaacagaaacgagcttttctgtggtcagcgcatcctcacacccaccgctgctgtgaaaagctggctgtaatgccattgagtgctgggatggaagctgacactcttgtcagctgaaaacctctaaacagaaacaggaggagagccctgggcttgcagggaggggcatctgacagcttgtctctttttcatggtagtggggagggtggagggtgggatgaggccacatttttgctgagtgtctgggaccaagagatccaggaacaacgggggcagttagcaccaaagtagtacttaaaggaaaaactcagcccttcaggcaggaaggcaaggacagtgcttgttgccttccacagtttccagaaaagcctgttattcacagccactaaaggacctggccctggcctggcctggcagacactgaagagggctgtttttctgatgctaatgtgcagcctagctttcattttctttcttttttttttttttttaatgaggggcctactcatcttgaaaccttttcaaataggtctccccctccctttcttccagtctctccacccccaccctctttgtttttaagcaggaaaacttgtttcccccaaatgcatccatagagatgggaaaattaatttaaacagacatgtgtcaaccccgttcttaaaaaaaagggacaagtatgacgttacaaaattgtacttcaggaatcattatgcagaacagagcatggtggtgtcttgattcaacgttcaccttaaaagcaagggggggcagccatcccccaggggcctgttgtcagccctcttccttttcctctctctgcagcctagcttttattctgcaattcataga

SEQ ID NO: 466409 - DNA, 2225 bp, Homo sapiens
tcttcttgcgtgactgatcgaccctatgaggcttttgtggttaaaatataaagttcctgaaaaaacctttccaaatctgaatgggattgcagtgacatcaaagcttttcctcttcaatacctttcatctttttcagactctggcactctccccaccagcttcaagtcaattaattgaaaagtcattagaaagctcctctgctgtgaaggcccacctcatcagctccatatctgggtccttcaagaaggaacagaagggccgttggcctccacattattggtgcttcgcccacctccaccctgttctggtctcagatgtttgtcctgtggccctagacatgaaatccctagccatttctcttagaaaatgcaagccatggtcacaaggaaaacctagaaaaggcagcgtgggcacaaaccatggcacagaagcagctgaaggagcctgctttcttgttggggaacgctggaatggagatagcacctctgaatcctcccaagtggatgatctggcaaagtccaagatacagaaattattctttcaaatagaggagtgcaggaaatccaatcctgaagatctccttccagttggctagcctgtgacccagaaatcactaccatgaatcaacgtgaaagtatgccaagccaccctgaggagccacatagaaaacagatgctctctggaaccagactgaaattgaaatgcaagatatatatatatatatatatatcacagaatctctgtcactaaatattctcccagaggcaaaggagctgggatatttacaccctgactctcatcattaagtggatggctcttggagggtatttgaactctctcacacatctggactgccaagaacacagacatgatgcttggagctatagcagccatctcgcaatcatgaggaaaggccaagagaatttctgagtcaccaaacccagcactgttcagctgctgagccaatccctacagcctcctatctctagaccttgtgctctgtgagaaaactaaaaccccattttgtttaatgccctcctgctccgagagttcaggttttctattccttacagtggaatgcatttcaaactgatataactgatccctcagccaaatactattcccagcagatggttagggttggctgtgtacagctatgcaaactgcacactccgggagacaccattcagaatgcctttggacttgtgtagtgcaaaacctgcattaagatgcaagctgttttctctggtgctgatatcagctgcccttctacctctgagaagatcatcctgagcttcctcttggagaataaatggtgcccatttctgtaagagactgtagcagcagctggcaccctgcgccctcacgcttctgctaaacagaaacgagcttttctgtggtcagcgcatcctcacacccaccgctgctgtgaaaagctggctgtaatgccattgagtgctgggatggaagctgacactcttgtcagctgaaaacctctaaacagaaacaggaggagagccctgggcttgcagggaggggcatctgacagcttgtctctttttcatggtagtggggagggtggagggtgggatgaggccacatttttgctgagtgtctgggaccaagagatccaggaacaacgggggcagttagcaccaaagtagtacttaaaggaaaaactcagcccttcaggcaggaaggcaaggacagtgcttgttgccttccacagtttccagaaaagcctgttattcacagccactaaaggacctggccctggcctggcctggcagacactgaagagggctgtttttctgatgctaatgtgcagcctagctttcattttctttcttttttttttttttttaatgaggggcctactcatcttgaaaccttttcaaataggtctccccctccctttcttccagtctctccacccccaccctctttgtttttaagcaggaaaacttgtttcccccaaatgcatccatagagatgggaaaattaatttaaacagacatgtgtcaaccccgttcttaaaaaaaagggacaagtatgacgttacaaaattgtacttcaggaatcattatgcagaacagagcatggtggtgtcttgattcaacgttcaccttaaaagcaagggggggcagccatcccccaggggcctgttgtcagccctcttccttttcctctctctgcagcctagcttttattctgcaattcataga

SEQ ID NO: 466410 - DNA, 2871 bp, Homo sapiens
cctcctgctgagccccagagctgatacagcacagccccacagagacatcagagacatgtgcacacacggccctgggattgccgacagacacacaggcacacataggcacgtacacacaggcatacagacacaggcacagactcacactcggcccctccccactcacactcgctcacactcatgctcacactcacaccaacccccctcccccaaatctgctgcgcaccaacggttggtgcgagcggggttgagaacgggaggaaaaaagcccacgactcagcccgggaagaggggtgcggtgggggaagggcgggcgagggaaatgacagcccgcggtccccctcgagtcccggctcatgaatattaatacggcggtaattaaaatgcagggacgcagcaggatggatgcggctgcctccggagcgcgggggagcgcggagtctttgcaggcgggtgaagcccgctcctcgccggcgaaaagcggggccgggctccggggcctgggtccggggcgggcgggagtggggacatttttcgtggtcccgagcgtcccgtcccggcgtccccgcccccgccccgcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagcccagtgcagatgcatctgacttacgaaacttcagtgacacctgctctgtgccagacactgaagatggagcagtgaacagcactgacccagcctgtcctcctgttgcctgcaggccagacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacggagtcttgctctgtcgcccaggctggagtgcagtggccccgatctcggctcaccgcaagctccgcctcgcgggttcatgccattctccggcctcagcctcccgagtagctgggactacaggcatccgccaccacacccagctaattttttgtattttttttagtagagacggggtttcactgtgttagccaggatggtctcgatcccctgaccttgtgatccacccaaggcctcggcctcccaaagtgctgggattacaggcatgagccaccgtgcccggtcaatttttatattttttgtagagacagggtttcaccatgttggccaggctggtgtcgaactcccgacctcaggtgattgtcggccttggcctcccaaagtgctgggattacaggcgtgagccaccgcgcccagccggtgggcagccagttgtgttccgggaggaggaggacaccctggaaagacagtggggccagacactgaactgcctttggaagcaagtaggagcaacagcgaaggtttgctggctcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcgatgccgttccattgtttgctgacttgcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaaccttggaatattttcagcataatttttttcctgtcttcttctctctcttttctcctctgaaatgccaattaaatatatgtt

SEQ ID NO: 466411 - DNA, 1070 bp, Homo sapiens
aattaggctaggtacgaggccggggttaatcggccgagggtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466412 - DNA, 657 bp, Homo sapiens
tacgggcatatgtcgacccacgcgtcgcggacgcgtgggctgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466413 - DNA, 565 bp, Homo sapiens
gacatggtgggggcagccaggaacggtgtgccagggggaggaacagcttgagcaaaggtgcagagaggagacaggcaaagagaaccacatgtgacatggtgggacatgccggaatcttccagagaggtgggccacatgtgacatggtgggacatgccggaatcttccagagaggtgggcctctgatgcaagcagacgggtctgccctggatctgcaggcagtggacagctatgggcatgtgggagcgggagaggggaagggagcttccagctctagacacagtgagggtgcccagcagccagggacccaggctggtggtgggggagtgtcactggggcaggtgtcagggccttagctctgggacagcatgtgtgtgtgttagaatgagtgtaaaagtatgagagggagtgcgagagtgtgtgtgtatgagtgtgtatatgaatgtgagtgtgtgagtattcgtgtgttgggtctgaggggcttgtcactgtgatcggctggctcatgtgtgtcctgtgggctgccatgtgtgtagtgtttactgtcacgtcactgtgagacccgt

SEQ ID NO: 466414 - DNA, 435 bp, Homo sapiens
cctgcctcagcctcctgagtagctgggattacaggtgcccaccaccacgcccagctaatttttagagacagggtttcaccatgttgcccaggctggtctcaaactcctgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttcaccatgttggccaggctggtctcaaactcctgacctcaggtgatccgcctgcctcggcctgcgataaaattgcacagaagtaaatacacacacgt

SEQ ID NO: 466415 - DNA, 1262 bp, Homo sapiens
gtaaaatgggctaacactgaaagaaccttgcagaatctcagcaacgtcacagaggacattgttagcacagccagcgggctcctgctgggctgagtttgtgggtaatccaagcctcggcaggtacagttcctccctcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466416 - DNA, 2280 bp, Homo sapiens
cctcctgctgagccccagagctgatacagcacagccccacagagacatcagagacatgtgcacacacggccctgggattgccgacagacacacaggcacacataggcacgtacacacaggcatacagacacaggcacagactcacactcggcccctccccactcacactcgctcacactcatgctcacactcacaccaacccccctcccccaaatctgctgcgcaccaacggttggtgcgagcggggttgagaacgggaggaaaaaagcccacgactcagcccgggaagaggggtgcggtgggggaagggcgggcgagggaaatgacagcccgcggtccccctcgagtcccggctcatgaatattaatacggcggtaattaaaatgcagggacgcagcaggatggatgcggctgcctccggagcgcgggggagcgcggagtctttgcaggcgggtgaagcccgctcctcgccggcgaaaagcggggccgggctccggggcctgggtccggggcgggcgggagtggggacatttttcgtggtcccgagcgtcccgtcccggcgtccccgcccccgccccgcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466417 - DNA, 1164 bp, Homo sapiens
tacgggcatatgtcgacccacgcgtcgcggacgcgtgggcggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466418 - DNA, 2122 bp, Homo sapiens
gagggggtactcagagtatccgaggaggagactcctggatgctaacagagcccccagttaggagcagtccgcgagacagttggtaacagtgctggccttgcccgggcgccggaaggttccgtgaggcccagcaagtcctgacttggcacagggcccagcacacggcgcagtaacaatataattaccgtatgcagtcccccaggatacagggtcaaaggagagcacaaccatcgcagttggaagcccatggggcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacggagtcttgctctgtcgcccaggctggagtgcagtggccccgatctcggctcaccgcaagctccgcctcgcgggttcatgccattctccggcctcagcctcccgagtagctgggactacaggcatccgccaccacacccagctaattttttgtattttttttagtagagacggggtttcactgtgttagccaggatggtctcgatcccctgaccttgtgatccacccaaggcctcggcctcccaaagtgctgggattacaggcatgagccaccgtgcccggtcaatttttatattttttgtagagacagggtttcaccatgttggccaggctggtgtcgaactcccgacctcaggtgattgtcggccttggcctcccaaagtgctgggattacaggcgtgagccaccgcgcccagccggtgggcagccagttgtgttccgggaggaggaggacaccctggaaagacagtggggccagacactgaactgcctttggaagcaagtaggagcaacagcgaaggtttgctggctcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466419 - DNA, 3563 bp, Homo sapiens
gatgatgtgatacatatcacatattccgtactccccaccctaacacatttaagcatatgcataaagcagacgaggaaagattctaaataggctctgaatctcagttttctcatctctacaatggggcagtgatggcatgcacctcccagggctgttctgagaatctgatgcctcccattgcactggtgagcctggcacaggcacaggtcccaccccaggccctttgaactggctgttcctttggcctggaacattcctccccagatacctcctgagagggctccctcacttccttcaaggcactgctcaaatgctacctcttcacagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagagacaaagaacactgcccacccccccgggggagcctgcgcccctcaccggaaagagaagcaggggggagcagagggagcttgcagccccacacgcagggctgccagaaggccatacataattcattgccaaatggggctgcgggcggctctccgcggcgtgcgctgggggctcactctgcgcctggcacttcgctgactgcgcctcacacgttgcctcattgcatcttcatggatttgcagggtgtgacccttccccctgttttacccagggggatcctgaggctcagaggatggggccaccgtgctagtcacacagcctctctgtggccaagctgggcctcgggccagcagattcggcccccagcggcccccattcactgcctctctgctgagggaaaagacgggcctggggagcgggtgggaggcacaaaggagaccccgctctgagacaggctgcagaagagggagctgggtctcagcagggctggggaaggctctggccccagccctccgcccaaccccctgccctcctctcctggaggagatgctccccaaattagccatcatgagcgctggctctgggggttgggcgttggggagcagtttgctcagctgtaaaatgggaataacagaaaccgtccctgggactatgagatcaaggtgctcaagaaaagtggtgtctgctgaggggaaaagccagtcccaaaaggttgcatactctcattctgtttatttgtttttgtttttgagacagggtctcgccctgtcacccaggctggagtacagtggcgcaatatgggctcactgcaacctccacctcctgggctcaagtgatcctcccatctcagaccctcaaggagctggggctacaggcacgtgccaccgtgtccggctaatttttgtattttatgtagagacagggtttcaccatgttgcccaggctggtctcaaactcctgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttttggagacgctctgtcgcccaggctggagtgcagtggcgcgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttggccaggatggtctcaatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaattaaaaagcgttatcttcctctgcccggaaagggttaagtgagtcactgcagttagctccccttcccccacaaccacctagaccaggccaggaccagcgggcaattgcctggcagctggagttttcctccactgtggactgtacttcttgcgtcactctgaatgtctccagtctttattccagaatgttctggtcctctcccacttttccaaggacaggaattccctagtggggctccagaagaggctctggaggagaacaagaaaggcccttgtcatccattggcctcaggctgggaaatctcggttccactcccagcccagcctcaatattaggttgtcagtctggagtctgagagccatgcccccacccccttagtccttcacctccaggagagttggggatactggaaagaatgttgagtgtcagagcccctctcagtggctcacgcctgaaatcccagccctttgggaggctgaggcaggtggattgcttgaggccaggagttcaagaccagcctggccaacgcgacgaagccctgactctactgaaaatacaaaaattagctgggcgtggtggcacacacctgtaatcccagcagctcgggaggctgaggcaggagaattgtttgaacctgagaggtggaggttgcagtgagctgagatcacaacactgcactcaaaaagtagttaattaatttagtttaattaaaaaagaatattgagtgtcaggcaatctgggtagaacccattgtgtttctacaggatagaatctgctgtgttctctagcggaacttccggatcaccttcaccgtatgactctagacaatccctgtccactcttcagttttagatgccccattcaaagaatgaaagaattgtcctagatgatcctttagggtcttccaggctgatgacaagggggacctggcccctctgctgctggccaaagaggactttacttcccattccgtgtggttgaacaagaattgctgggctccagtcctgcctttggcccttccctacatgtgaccttgggccctctttgcctttcagaatcaatacagtgagagagttaaca

SEQ ID NO: 466420 - DNA, 1073 bp, Homo sapiens
gacatggtgggggcagccaggaacggtgtgccagggggaggaacagcttgagcaaaggtgcagagaggagacaggcaaagagaaccacatgtgacatggtgggacatgccggaatcttccagagagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466421 - DNA, 2258 bp, Homo sapiens
cctcctgctgagccccagagctgatacagcacagccccacagagacatcagagacatgtgcacacacggccctgggattgccgacagacacacaggcacacataggcacgtacacacaggcatacagacacaggcacagactcacactcggcccctccccactcacactcgctcacactcatgctcacactcacaccaacccccctcccccaaatctgctgcgcaccaacggttggtgcgagcggggttgagaacgggaggaaaaaagcccacgactcagcccgggaagaggggtgcggtgggggaagggcgggcgagggaaatgacagcccgcggtccccctcgagtcccggctcatgaatattaatacggcggtaattaaaatgcagggacgcagcaggatggatgcggctgcctccggagcgcgggggagcgcggagtctttgcaggcgggtgaagcccgctcctcgccggcgaaaagcggggccgggctccggggcctgggtccggggcgggcgggagtggggacatttttcgtggtcccgagcgtcccgtcccggcgtccccgcccccgccccgcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgaaaaaaaaaaaaaaaaaaaaaaaacccggggttttttcggggcgggaaaaagggtataaagggcctggcttagctgtttctgccccacttcttgtgcacagggaaatcggcggcccaaagggggggataataaacccggaca

SEQ ID NO: 466422 - DNA, 2486 bp, Homo sapiens
gatgatgtgatacatatcacatattccgtactccccaccctaacacatttaagcatatgcataaagcagacgaggaaagattctaaataggctctgaatctcagttttctcatctctacaatggggcagtgatggcatgcacctcccagggctgttctgagaatctgatgcctcccattgcactggtgagcctggcacaggcacaggtcccaccccaggccctttgaactggctgttcctttggcctggaacattcctccccagatacctcctgagagggctccctcacttccttcaaggcactgctcaaatgctacctcttcacagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagagacaaagaacactgcccacccccccgggggagcctgcgcccctcaccggaaagagaagcaggggggagcagagggagcttgcagccccacacgcagggctgccagaaggccatacataattcattgccaaatggggctgcgggcggctctccgcggcgtgcgctgggggctcactctgcgcctggcacttcgctgactgcgcctcacacgttgcctcattgcatcttcatggatttgcagggtgtgacccttccccctgttttacccagggggatcctgaggctcagaggatggggccaccgtgctagtcacacagcctctctgtggccaagctgggcctcgggccagcagattcggcccccagcggcccccattcactgcctctctgctgagggaaaagacgggcctggggagcgggtgggaggcacaaaggagaccccgctctgagacaggctgcagaagagggagctgggtctcagcagggctggggaaggctctggccccagccctccgcccaaccccctgccctcctctcctggaggagatgctccccaaattagccatcatgagcgctggctctgggggttgggcgttggggagcagtttgctcagctgtaaaatgggaataacagaaaccgtccctgggactatgagatcaaggtgctcaagaaaagtggtgtctgctgaggggaaaagccagtcccaaaaggttgcatactctcattctgtttatttgtttttgtttttgagacagggtctcgccctgtcacccaggctggagtacagtggcgcaatatgggctcactgcaacctccacctcctgggctcaagtgatcctcccatctcagaccctcaaggagctggggctacaggcacgtgccaccgtgtccggctaatttttgtattttatgtagagacagggtttcaccatgttgcccaggctggtctcaaactcctgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttttggagacgctctgtcgcccaggctggagtgcagtggcgcgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttggccaggatggtctcaatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaatta

SEQ ID NO: 466423 - DNA, 1607 bp, Homo sapiens
  misc_feature (1579)..(1579): n is a, c, g, or t
  misc_feature (1600)..(1600): n is a, c, g, or t
  misc_feature (1603)..(1603): n is a, c, g, or t
gatgatgtgatacatatcacatattccgtactccccaccctaacacatttaagcatatgcataaagcagacgaggaaagattctaaataggctctgaatctcagttttctcatctctacaatggggcagtgatggcatgcacctcccagggctgttctgagaatctgatgcctcccattgcactggtgagcctggcacaggcacaggtcccaccccaggccctttgaactggctgttcctttggcctggaacattcctccccagatacctcctgagagggctccctcacttccttcaaggcactgctcaaatgctacctcttcacagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagagacaaagaacactgcccacccccccgggggagcctgcgcccctcaccggaaagagaagcaggggggagcagagggagcttgcagccccacacgcagggctgccagaaggccatacataattcattgccaaatggggctgcgggcggctctccgcggcgtgcgctgggggctcactctgcgcctggcacttcgctgactgcgcctcacacgttgcctcattgcatcttcatggatttgcagggtgtgacccttccccctgttttacccagggggatcctgaggctcagaggatggggccaccgtgctagtcacacagcctctctgtggccaagctgggcctcgggccagcagattcggcccccagcggcccccattcactgcctctctgctgagggaaaagacgggcctggggagcgggtgggaggcacaaaggagaccccgctctgagacaggctgcagaagagggagctgggtctcagcagggctggggaaggctctggccccagccctccgcccaaccccctgccctcctctcctggaggagatgctccccaaattagccatcatgagcgctggctctgggggttgggcgttggggagcagtttgctcagctgtaaaatgggaataacagaaaccgtccctgggactatgagatcaaggtgctcaagaaaagtggtgtctgctgaggggaaaagccagtcccaaaaggttgcatactctcattctgtttatttgtttttgtttttgagacagggtctcgccctgtcacccaggctggagtacagtgagccaagatcgcgccactacactccagtccgggcgacngagcaagagtccattcccccnccnccaa

SEQ ID NO: 466424 - DNA, 3023 bp, Homo sapiens
cctcctgctgagccccagagctgatacagcacagccccacagagacatcagagacatgtgcacacacggccctgggattgccgacagacacacaggcacacataggcacgtacacacaggcatacagacacaggcacagactcacactcggcccctccccactcacactcgctcacactcatgctcacactcacaccaacccccctcccccaaatctgctgcgcaccaacggttggtgcgagcggggttgagaacgggaggaaaaaagcccacgactcagcccgggaagaggggtgcggtgggggaagggcgggcgagggaaatgacagcccgcggtccccctcgagtcccggctcatgaatattaatacggcggtaattaaaatgcagggacgcagcaggatggatgcggctgcctccggagcgcgggggagcgcggagtctttgcaggcgggtgaagcccgctcctcgccggcgaaaagcggggccgggctccggggcctgggtccggggcgggcgggagtggggacatttttcgtggtcccgagcgtcccgtcccggcgtccccgcccccgccccgcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagcccagtgcagatgcatctgacttacgaaacttcagtgacacctgctctgtgccagacactgaagatggagcagtgaacagcactgacccagcctgtcctcctgttgcctgcaggccagacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacggagtcttgctctgtcgcccaggctggagtgcagtggccccgatctcggctcaccgcaagctccgcctcgcgggttcatgccattctccggcctcagcctcccgagtagctgggactacaggcatccgccaccacacccagctaattttttgtattttttttagtagagacggggtttcactgtgttagccaggatggtctcgatcccctgaccttgtgatccacccaaggcctcggcctcccaaagtgctgggattacaggcatgagccaccgtgcccggtcaatttttatattttttgtagagacagggtttcaccatgttggccaggctggtgtcgaactcccgacctcaggtgattgtcggccttggcctcccaaagtgctgggattacaggcgtgagccaccgcgcccagccggtgggcagccagttgtgttccgggaggaggaggacaccctggaaagacagtggggccagacactgaactgcctttggaagcaagtaggagcaacagcgaaggtttgctggctcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcgtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcagatgccgttccattgtttgctgacttgcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaaccttggaatattttcagcataatttttttcctgtcttcttctctctcttttctcctctgaaatgccaattaaatatatgtt

SEQ ID NO: 466425 - DNA, 552 bp, Homo sapiens
  misc_feature (34)..(34): n is a, c, g, or t
  misc_feature (41)..(41): n is a, c, g, or t
cgaaaaaaaaatttggttcctttaccaaaagggncccgggnccaaaaggggggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466426 - DNA, 1982 bp, Homo sapiens
ctacgaattcgaggtttctcctgcctcagcctctcaagcagcaggtgcaagccaccgtgtccggctaatttttgtattttatgtagagacagggtttcaccatgttgcccaggctggtctcaaactcctgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttttggagacgctctgtcgcccaggctggagtgcagtggcgcgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttggccaggatggtctcaatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaattaaaaagcgttatcttcctctgcccggaaagggttaagtgagtcactgcagttagctccccttcccccacaaccacctagaccaggccaggaccagcgggcaattgcctggcagctggagttttcctccactgtggactgtacttcttgcgtcactctgaatgtctccagtctttattccagaatgttctggtcctctcccacttttccaaggacaggaattccctagtggggctccagaagaggctctggaggagaacaagaaaggcccttgtcatccattggcctcaggctgggaaatctcggttccactcccagcccagcctcaatattaggttgtcagtctggagtctgagagccatgcccccacccccttagtccttcacctccaggagagttggggatactggaaagaatgttgagtgtcagagcccctctcagtggctcacgcctgaaatcccagccctttgggaggctgaggcaggtggattgcttgaggccaggagttcaagaccagcctggccaacgcgacgaagccctgactctactgaaaatacaaaaattagctgggcgtggtggcacacacctgtaatcccagcagctcgggaggctgaggcaggagaattgtttgaacctgagaggtggaggttgcagtgagctgagatcacaacactgcactcaaaaagtagttaattaatttagtttaattaaaaaagaatattgagtgtcaggcaatctgggtagaacccattgtgtttctacaggatagaatctgctgtgttctctagcggaacttccggatcaccttcaccgtatgactctagacaatccctgtccactcttcagttttagatgccccattcaaagaatgaaagaattgtcctagatgatcctttagggtcttccaggctgatgacaagggggacctggcccctctgctgctggccaaagaggactttacttcccattccgtgtggttgaacaagaattgctgggctccagtcctgcctttggcccttccctacatgtgaccttgggccctctttgcctttcagaatcaatacagtgagagagttaaca

SEQ ID NO: 466427 - DNA, 259 bp, Homo sapiens
cgagctcggtacccctctctccacactggggcaggtgtcagggccttagctctgggacagcatgtgtgtgtgttagaatgagtgtaaaagtatgagagggagtgcgagagtgtgtgtgtatgagtgtgtatatgaatgtgagtgtgtgagtattcgtgtgttgggtctgaggggcttgtcactgtgatcggctggctcatgtgtgtcctgtgggctgccatgtgtgtagtgtttactgtcacgtcactgtgagacccgt

SEQ ID NO: 466428 - DNA, 136 bp, Homo sapiens
gcaacagcgaaggtttgctggctcaggtaggaggattaattggaacgattaagctggaagctctgtaagacggattagaggggcaaacttggaggcaggaaggctgggaggagaccactgctgagtgatttttctt

SEQ ID NO: 466429 - DNA, 401 bp, Homo sapiens
gccttggcccagctggggctagatggcaagaggtggttcagcattggagctccattgcctgggttcaaatcggggtctgtcactggccagctgtgagcctaagtctctgaacttctctgtgccttagtgtcctcattctgtagagtggagatagtaatcattcctatttcaaagattgttgtgagaaataagtgaactaatacatgtcatatgcttaaaagcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccag

SEQ ID NO: 466430 - DNA, 2457 bp, Homo sapiens
cctcctgctgagccccagagctgatacagcacagccccacagagacatcagagacatgtgcacacacggccctgggattgccgacagacacacaggcacacataggcacgtacacacaggcatacagacacaggcacagactcacactcggcccctccccactcacactcgctcacactcatgctcacactcacaccaacccccctcccccaaatctgctgcgcaccaacggttggtgcgagcggggttgagaacgggaggaaaaaagcccacgactcagcccgggaagaggggtgcggtgggggaagggcgggcgagggaaatgacagcccgcggtccccctcgagtcccggctcatgaatattaatacggcggtaattaaaatgcagggacgcagcaggatggatgcggctgcctccggagcgcgggggagcgcggagtctttgcaggcgggtgaagcccgctcctcgccggcgaaaagcggggccgggctccggggcctgggtccggggcgggcgggagtggggacatttttcgtggtcccgagcgtcccgtcccggcgtccccgcccccgccccgcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466431 - DNA, 3200 bp, Homo sapiens
cctcctgctgagccccagagctgatacagcacagccccacagagacatcagagacatgtgcacacacggccctgggattgccgacagacacacaggcacacataggcacgtacacacaggcatacagacacaggcacagactcacactcggcccctccccactcacactcgctcacactcatgctcacactcacaccaacccccctcccccaaatctgctgcgcaccaacggttggtgcgagcggggttgagaacgggaggaaaaaagcccacgactcagcccgggaagaggggtgcggtgggggaagggcgggcgagggaaatgacagcccgcggtccccctcgagtcccggctcatgaatattaatacggcggtaattaaaatgcagggacgcagcaggatggatgcggctgcctccggagcgcgggggagcgcggagtctttgcaggcgggtgaagcccgctcctcgccggcgaaaagcggggccgggctccggggcctgggtccggggcgggcgggagtggggacatttttcgtggtcccgagcgtcccgtcccggcgtccccgcccccgccccgcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacggagtcttgctctgtcgcccaggctggagtgcagtggccccgatctcggctcaccgcaagctccgcctcgcgggttcatgccattctccggcctcagcctcccgagtagctgggactacaggcatccgccaccacacccagctaattttttgtattttttttagtagagacggggtttcactgtgttagccaggatggtctcgatcccctgaccttgtgatccacccaaggcctcggcctcccaaagtgctgggattacaggcatgagccaccgtgcccggtcaatttttatattttttgtagagacagggtttcaccatgttggccaggctggtgtcgaactcccgacctcaggtgattgtcggccttggcctcccaaagtgctgggattacaggcgtgagccaccgcgcccagccggtgggcagccagttgtgttccgggaggaggaggacaccctggaaagacagtggggccagacactgaactgcctttggaagcaagtaggagcaacagcgaaggtttgctggctcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466432 - DNA, 1218 bp, Homo sapiens
tcacacagccggccggccccaagtgacaggggccgaagacgtagttgtctgacctgtgctctaaccactgtgctctctggcctcaagccggctcccacactacccttccctgttctccgtggccctccagcgcctgaaagccgcttgggggccgcggaggcaggtggcatggccagggcagagtccgcggggcggaaagggttaacgggctccgccgcattgggctgtccttcaaggggggagccagccaatgagcgcgcgccgcgatgagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaa

SEQ ID NO: 466433 - DNA, 3333 bp, Homo sapiens
cccagaaagttgattatttttaacccaggaagaagaaaggaaggaggcgagggagaaggactcagagaaaagaggagaggaaaagagaggagaggagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagagacaaagaacactgcccacccccccgggggagcctgcgcccctcaccggaaagagaagcaggggggagcagagggagcttgcagccccacacgcagggctgccagaaggccatacataattcattgccaaatggggctgcgggcggctctccgcggcgtgcgctgggggctcactctgcgcctggcacttcgctgactgcgcctcacacgttgcctcattgcatcttcatggatttgcagggtgtgacccttccccctgttttacccagggggatcctgaggctcagaggatggggccaccgtgctagtcacacagcctctctgtggccaagctgggcctcgggccagcagattcggcccccagcggcccccattcactgcctctctgctgagggaaaagacgggcctggggagcgggtgggaggcacaaaggagaccccgctctgagacaggctgcagaagagggagctgggtctcagcagggctggggaaggctctggccccagccctccgcccaaccccctgccctcctctcctggaggagatgctccccaaattagccatcatgagcgctggctctgggggttgggcgttggggagcagtttgctcagctgtaaaatgggaataacagaaaccgtccctgggactatgagatcaaggtgctcaagaaaagtggtgtctgctgaggggaaaagccagtcccaaaaggttgcatactctcattctgtttatttgtttttgtttttgagacagggtctcgccctgtcacccaggctggagtacagtggcgcaatatgggctcactgcaacctccacctcctgggctcaagtgatcctcccatctcagaccctcaaggagctggggctacaggcacgtgccaccgtgtccggctaatttttgtattttatgtagagacagggtttcaccatgttgcccaggctggtctcaaactcctgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttttggagacgctctgtcgcccaggctggagtgcagtggcgcgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttggccaggatggtctcaatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaattaaaaagcgttatcttcctctgcccggaaagggttaagtgagtcactgcagttagctccccttcccccacaaccacctagaccaggccaggaccagcgggcaattgcctggcagctggagttttcctccactgtggactgtacttcttgcgtcactctgaatgtctccagtctttattccagaatgttctggtcctctcccacttttccaaggacaggaattccctagtggggctccagaagaggctctggaggagaacaagaaaggcccttgtcatccattggcctcaggctgggaaatctcggttccactcccagcccagcctcaatattaggttgtcagtctggagtctgagagccatgcccccacccccttagtccttcacctccaggagagttggggatactggaaagaatgttgagtgtcagagcccctctcagtggctcacgcctgaaatcccagccctttgggaggctgaggcaggtggattgcttgaggccaggagttcaagaccagcctggccaacgcgacgaagccctgactctactgaaaatacaaaaattagctgggcgtggtggcacacacctgtaatcccagcagctcgggaggctgaggcaggagaattgtttgaacctgagaggtggaggttgcagtgagctgagatcacaacactgcactcaaaaagtagttaattaatttagtttaattaaaaaagaatattgagtgtcaggcaatctgggtagaacccattgtgtttctacaggatagaatctgctgtgttctctagcggaacttccggatcaccttcaccgtatgactctagacaatccctgtccactcttcagttttagatgccccattcaaagaatgaaagaattgtcctagatgatcctttagggtcttccaggctgatgacaagggggacctggcccctctgctgctggccaaagaggactttacttcccattccgtgtggttgaacaagaattgctgggctccagtcctgcctttggcccttccctacatgtgaccttgggccctctttgcctttcagaatcaatacagtgagagagttaaca

SEQ ID NO: 466434 - DNA, 2339 bp, Homo sapiens
cctcctgctgagccccagagctgatacagcacagccccacagagacatcagagacatgtgcacacacggccctgggattgccgacagacacacaggcacacataggcacgtacacacaggcatacagacacaggcacagactcacactcggcccctccccactcacactcgctcacactcatgctcacactcacaccaacccccctcccccaaatctgctgcgcaccaacggttggtgcgagcggggttgagaacgggaggaaaaaagcccacgactcagcccgggaagaggggtgcggtgggggaagggcgggcgagggaaatgacagcccgcggtccccctcgagtcccggctcatgaatattaatacggcggtaattaaaatgcagggacgcagcaggatggatgcggctgcctccggagcgcgggggagcgcggagtctttgcaggcgggtgaagcccgctcctcgccggcgaaaagcggggccgggctccggggcctgggtccggggcgggcgggagtggggacatttttcgtggtcccgagcgtcccgtcccggcgtccccgcccccgccccgcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcgtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcagatgccgttccattgtttgctgacttgcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaaccttggaatattttcagcataatttttttcctgtcttcttctctctcttttctcctctgaaatgccaattaaatatatgtt

SEQ ID NO: 466435 - DNA, 1309 bp, Homo sapiens
cctcctgctgagccccagagctgatacagcacagccccacagagacatcagagacatgtgcacacacggccctgggattgccgacagacacacaggcacacataggcacgtacacacaggcatacagacacaggcacagactcacactcggcccctccccactcacactcgctcacactcatgctcacactcacaccaacccccctcccccaaatctgctgcgcaccaacggttggtgcgagcggggttgagaacgggaggaaaaaagcccacgactcagcccgggaagaggggtgcggtgggggaagggcgggcgagggaaatgacagcccgcggtccccctcgagtcccggctcatgaatattaatacggcggtaattaaaatgcagggacgcagcaggatggatgcggctgcctccggagcgcgggggagcgcggagtctttgcaggcgggtgaagcccgctcctcgccggcgaaaagcggggccgggctccggggcctgggtccggggcgggcgggagtggggacatttttcgtggtcccgagcgtcccgtcccggcgtccccgcccccgccccgcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcatccgggcgacagagcaagagtccattcccccaccacca

SEQ ID NO: 466436 - DNA, 365 bp, Homo sapiens
tgtaagattctcccggggcctgaaagcttaaggagatgaataactcctcccttctcaggcccagtcccaaggcgcaagggccacttgtgtcagcagtgtgcaccagcagcgtgcgccggcaagatagcagaagcatgaaaagggccggccagaagacacctactctggctggaagacacgtacccctgaagatcaagaaagaagctatctgggaacaatgtagcagttacgtcagaccaggacacttcctgtttacaggagactataaaacctttgtcctatcatcacttgatgtggacgccattttaggcctcagcccgcctgcacccaggcactgattaaaacagcatgttgctccacactgc

SEQ ID NO: 466437 - DNA, 605 bp, Homo sapiens
cagcatgttgctccacactgcctcgtgttgtctactctacagacacatcacttctcctcctttgttccccttccagttctgctatggaagaagcaacatctaagatgacggaaattatttcagagcccacagttacactggaaaatgagaattcggatgtgaatccatctgcaggaaagtctggtccagggctctttctggttgaacacctgggggaaggggaggctgtgggcgcagcttcagcagacttaaatgttcctgccagacggctctgcagagagcagcgtatcctgacaaggaggattctcccagcacagaacgggagctccactaagggacagactgcttccttaagtgggtccctgacccccgtgcctcccgactgggagacagctcccagcaggggtcagcagacaccttatacaagagagctccagctggcatctggcaggtgcctctctgagacaaagcttccagatgaaggagcaggcagcagtctttgctgttctgcagcctctgctggtgatacccaggcaaacagggtctggagtggacctccggcaaactacagcagacatgcagaaaaggggcctgattgttagaag

SEQ ID NO: 466438 - DNA, 1641 bp, Homo sapiens
cttctcagccatgcagaactaatcactggtttatgaattaccgggtctggatgactagttggctatgactgggaaggaaggaggacataaagatagattttctagctcacatgacctggggaaacgctattggtttaaggtcttgtctctggaatcagagtggctacaacaggtgcttgatggtagccttgggcaaatgacatacttcttgcctagaaataatactctcacaatttatattctctgtctctctttggctacaaagaaaatcccccctgcacttcaaacagcagaggtctgccagatactccaccctcatcaatcttcatttaaatgccagcaacatgaccctatgaataaaggtgctccatttgtctacaagcaaaggctttccaaaacagacagaagaagtcccacttggggtgaagtttgcagttccatatgtttcagtgggagagggggaaaacgatgggatgaggggagcaaaaactggattcaaaagagaggaactatttagttcagtatcctaagacctcaatgctaagacatcagggaatccatccagccaacccctctcctcagtaaatgcaaaatataaataaatgacactcactctcattcccacccctcatatcagagaccacattaatgtaagagaacgaaaaaatactatgatgacgataactattctttattgaatagattctatgtgccagctctatcaagctataattcacatgccttaaaattcaccttttttgaaatgtacaactgagtgatttgtaatatattcacagagttgtgcaatcttaacaactacttaattccagaacatttacatcacttcaaagaaaccccataccctatagcagtcactcccaattctcttcttccacccattccctggaaaccactaatttactttccgtctctttggatttaactactcaggacattttatatttcaagtgattgaagatgtaaaaatgcaaccaggagtagctctgagaaacaccaggattatctatccacccttctgaagctgagcagcagatttatggaatcagaacagggaatggactgggtgcttaacaccaattagagctgcacatctgaagaagggaagagaaagatccaaaaatctcacaagataggaggagagtgcagatcagaacccaccaccttctctgactccaaatgcaatgctcttggcttgtctgcgcaccacttcttctccatctccaggtcactgcatttaattctatcccatctgagtatgtgaaatggaagcttgtttagaaaaatctttttatctgccacctcctgaatcttaattcgtcttagtgccaaaatgtatagtaatccacaaagctgaagaaggctgcatcatgtttgggacttgttccccgctcatttggatggctggatcagaaacaacagaagaaagagtgcttgtctcttgtgagtttgccaactgagtatttggattcagatggatcacacgcaacacatcaaattgtttttagctcagtatccaaacatttgatttttttatctacactaattccaaattttataaagttgttgaaagttgcttgtggataagttcatacatatttgaaaaagacacaaccaaaatac

SEQ ID NO: 466439 - DNA, 1935 bp, Homo sapiens
acacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtggtgggtgtttccaagctgtctctgccccccgccactgggctcctgggtgagctccgatggcacagggcgcctggagccccctgccccgctgaagccctgccttgccttccctgaatctcgcagttatttttgtgtccttcaccactaacccaaaggaacgaatgatttgtatgttgcacttcaaacaccaagtggactttctgctgggagcttgcccaggaccggcagcctctggagggacggtggttgctccccttgctgggttttgccgagcccccccggtgtgcatggtagggaccactcagatggggagctgtctcgaggccatctgcttaggtggttttgcgttccagctttggctgtctgtgctctgaagtccaggggccgggtcctccctgtgtccctgtcctgtttgggccacagatcaggtgcttgggtttctctcagcagcttccgcctgaggtaccctcatccaaaggaccaggggcccgatcagatcacatggctgacatttcttcctggaaggactttggtacctgaccagaaatgtctgtgagggtgggaggcagcgatgcagggttagatgcagggtttgctgtctgtttctagggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcatctggcctctcggacattctctgctccgcctccctcttgtgctgcttagggcctcaccccagcaggtggcaccgttgagggtgggacgggccccaccactgcttccctctcacctgatacccaatcctctggtcatctttcccgttccgtggccccgacttcttggtcttcgtagccagaggtgtgtggttgaggcccttttggaatgccctgctgccttcctggccagccttttctg

SEQ ID NO: 466440 - DNA, 1698 bp, Homo sapiens
acacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtggtgggtgtttccaagctgtctctgccccccgccactgggctcctgggtgagctccgatggcacagggcgcctggagccccctgccccgctgaagccctgccttgccttccctgaatctcgcagttatttttgtgtccttcaccactaacccaaaggaacgaatgatttgtatgttgcacttcaaacaccaagtggactttctgctgggagcttgcccaggaccggcagcctctggagggacggtggttgctccccttgctgggttttgccgagcccccccggtgtgcatggtagggaccactcagatggggagctgtctcgaggccatctgcttaggtggttttgcgttccagctttggctgtctgtgctctgaagtccaggggccgggtcctccctgtgtccctgtcctgtttgggccacagatcaggtgcttgggtttctctcagcagcttccgcctgaggtaccctcatccaaaggaccaggggcccgatcagatcacatggctgacatttcttcctggaaggactttggtacctgaccagaaatgtctgtgagggtgggaggcagcgatgcagggttagatgcagggtttgctgtctgtttctagggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcat

SEQ ID NO: 466441 - DNA, 3056 bp, Homo sapiens
  misc_feature (1712)..(1712): n is a, c, g, or t
  misc_feature (1717)..(1717): n is a, c, g, or t
acacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtggtgggtgtttccaagctgtctctgccccccgccactgggctcctgggtgagctccgatggcacagggcgcctggagccccctgccccgctgaagccctgccttgccttccctgaatctcgcagttatttttgtgtccttcaccactaacccaaaggaacgaatgatttgtatgttgcacttcaaacaccaagtggactttctgctgggagcttgcccaggaccggcagcctctggagggacggtggttgctccccttgctgggttttgccgagcccccccggtgtgcatggtagggaccactcagatggggagctgtctcgaggccatctgcttaggtggttttgcgttccagctttggctgtctgtgctctgaagtccaggggccgggtcctccctgtgtccctgtcctgtttgggccacagatcaggtgcttgggtttctctcagcagcttccgcctgaggtaccctcatccaaaggaccaggggcccgatcagatcacatggctgacatttcttcctggaaggactttggtacctgaccagaaatgtctgtgagggtgggaggcagcgatgcagggttagatgcagggtttgctgtctgtttctagggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcataaaaaaaaaaaaanaaaanaaaaaaaaaaaaaaaaaaaaaaaaaaaaaaaaaaaaaaaaaaaaaaaaaaaaaaaagaagaacagaagaaaaaaaagaaaacagacgaaaggatagcgcaactagacgacggagacggggaggaaggagcacgttgttgtgcgcagcagcgaagcgagaaggagacgagctgacggagcgcagagcggcgagcacgagcgacaggggcgggaggcgcgagagcagaaggagagggtaggagagaggcaggcccgcacccaggaggaagagccagcgagacgggagcaggcgaggcggcagaaacaggagagagagaggacagcgcaaaaacggaaagaaggaaaaggaaggagagagaaacgagagagaaaaggccagacgagccacaagcacgacgacagacagagcagcaaaaacaaaagagagcaggagaggaagacgaagaagagaacagagcggagaagagagcaagccggggccagggaggcggcggcacgaggcggggagagcagagagggaggagcaagacagagaccaagaaaccaacgagacgcacggcgcggagcacgaggagagcgagcacgagccgcgcgcccgcggcggcaaccaacaggagcgcaccagcaacagacaacgacagaccgagaacagcacaagaagccccagccagaacgacgcgcagagagagagggagagcgagagagggagaacagagggagcgggagcaagcgaagaagggcagaaggacgagcgaagccggacgcgaagagagaacggaacgagagagagcgagcaggaaagggagacaacaccgacgaaacgacagcgagacaaacgaccgaacagaccacagccgagacccaagagcacgagaccgcagcaaagacagggtagcgagcgacagaggcacagagacagaacagcaacacagaacagaacgaggaaagaccagcaacaaggaggcggaaagacgacccagagacgagggaaacgggcgcagaggagcgcgccgacggaacaagaaagaaacaaaaacaccgacacgccgagacacaaagcgaacgaaccagggaagaaaacacaccagacaccgaacaagaaagagagacagagaagaaaaacccacagacagagagcgcaggagaaagagaaaggaacagagagaagaagacagcgagggaggcgggcgagccgcgaagccggacgaaacgaaaaacgcacgcgggcaggagcgagagcggaggagaggcaggagacagacagcggaggggagacgcgcagaaaacacgaccagcggacacatggagacgaaacgacgaaaaaccaagggaacgaggca

SEQ ID NO: 466442 - DNA, 1542 bp, Homo sapiens
acacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtggtgggtgtttccaagctgtctctgccccccgccactgggctcctgggtgagctccgatggcacagggcgcctggagccccctgccccgctgaagccctgccttgccttccctgaatctcgcagttatttttgtgtccttcaccactaacccaaaggaacgaatgatttgtatgttgcacttcaaacaccaagtggactttctgctgggagcttgcccaggaccggcagcctctggagggacggtggttgctccccttgctgggttttgccgagcccccccggtgtgcatggtagggaccactcagatggggagctgtctcgaggccatctgcttaggtggttttgcgttccagctttggctgtctgtgctctgaagtccaggggccgggtcctccctgtgtccctgtcctgtttgggccacagatcaggtgcttgggtttctctcagcagcttccgcctgaggtaccctcatccaaaggaccaggggcccgatcagatcacatggctgacatttcttcctggaaggactttggtacctgaccagaaatgtctgtgagggtgggaggcagcgatgcagggttagatgcagggtttgctgtctgtttctagggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcaaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcat

SEQ ID NO: 466443 - DNA, 409 bp, Homo sapiens
gggttagtgggaagatgagacacaatatttactgtcaggtggtgaaaagcacatgcagcagggatgggccaaaggagactcaaactcgggctgggtgtcctgggcaggatggcactctatggagtcattgcatcgtctgctgtgtgctggccccgtttggccagagtgcactcaagtgtctgcttctttctttaagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcaggtgggtgtgctgcagtgcggtcgcgtccctgg

SEQ ID NO: 466444 - DNA, 1089 bp, Homo sapiens
acacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtgggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcat

SEQ ID NO: 466445 - DNA, 2742 bp, Homo sapiens
cctgtgagaaggacatgattatggggggagcggagggcaaactgagcacctctgggggcacagcggccctgggctgcctggtcaaggactacttccccgaaccggtgacggtgtcgtggaactcaggcgccctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggctgtggaccaccatcaccatcttcatcacactcttcctgctaagcgtgtgctacagtgccaccatcaccttcttcaaggttggccgcacgttgtccccagctgtccttgacattgtcccccatgctgtcacacactgtccccatgctgtccccacatgtccctgacactgtcccccatgctgtccccacctgtcccggacactctcctccgcactgtctcgacctgtgcccaacactgtcccccacgctatccccctatccccaacaatgtcccccacactgtttcctcctgtcccctatccccgacactgtcctccacactgtccccacctctccctgtcactgtcgcccatgctgcccccacctgtcccaacactttcctccaagctgtcctcacctgtccccaacactctcccccacactctctccacctgtccctgacactctcccccatgctgtccccacctgtccctgatgctgtcctccacactgtccccacctctccctgtcactgtccccatgctgtcccctgtccctcacactttcctccatgctgtcctcacctgtccccaacactctcccccactgtctccacctgtccctgacactgtcccccacactgtccccacctgtccctgatgctgtcgtctgtgctgtccacatactgttggtgacctggctctgttctccaagttcaagcctcagagcaggcagtggtgaggccgtggcacctgggtggcctgaggggtggggcgggccttgggggcagggctgtggcctcgctcacccctgtgctgtgccttgcctacaggtgaagtggatcttctcctcagtggtggacctgaagcagaccatcgtccccgactacaggaacatgatcaggcagggggcctagggccaccctctgtggggtgtccagggccgcccagacccccacacaggagccgtgggccatgctcagccatcacccaggccacacctgcccccgacctcaccgccctcaaccccatggctctctggcctcgcagtcgccctctgaccctgacacgccccccttccagaccctgtgcatagcaggtctaccccagacctccgctgcttggtgcatgcagggcgctgggggccaggacacgctgctgcagccccgcggggggtgagggagacagcacctggggtgcagggcgggcagctgctgcatcaccggctctatcccaagcccaaggatggcgtcccagagatgcaggagagctttgtccagagaaggtgccagccctcagggaccctgctggagagatctccaccctctgcccttcaaggggccctacgggcctccaggtgctctggtggggtgggctccagtccactgtctgaggatggacggcctggccaggataaggaaaggaaacccaggacggtgccgggctccgggtcattccgtgcactgagcaggctgagttgggaagaagcagatgcttcctgcagctgctgccccctgcagggcctggcgcctggaccaggttcccctggggaaattgggcccctccctgagccacccggggcccacctcccactttctacctgggaccgagcatcctccagagggtcagccctcctgcgggaacaccatgcccagccccaggaccctccctcaactctccagcaaggctgcccctgcacaccccccagcagcccatgctgtgatgtaacatgacatcgtgtgacatggtgcccctgccccacgtgacccaagtgggct

SEQ ID NO: 466446 - DNA, 2778 bp, Homo sapiens
cctgtgagaaggacatgattatggggggagcggagggcaaactgagcacctctgggggcacagcggccctgggctgcctggtcaaggactacttccccgaaccggtgacggtgtcgtggaactcaggcgccctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggctgtggaccaccatcaccatcttcatcacactcttcctgctaagcgtgtgctacagtgccaccatcaccttcttcaaggttggccgcacgttgtccccagctgtccttgacattgtcccccatgctgtcacacactgtccccatgctgtccccacatgtccctgacactgtcccccatgctgtccccacctgtcccggacactctcctccgcactgtctcgacctgtgcccaacactgtcccccacgctatccccctatccccaacaatgtcccccacactgtttcctcctgtcccctatccccgacactgtcctccacactgtccccacctctccctgtcactgtcgcccatgctgcccccacctgtcccaacactttcctccaagctgtcctcacctgtccccaacactctcccccacactctctccacctgtccctgacactctcccccatgctgtccccacctgtccctgatgctgtcctccacactgtccccacctctccctgtcactgtccccatgctgtcccctgtccctcacactttcctccatgctgtcctcacctgtccccaacactctcccccactgtctccacctgtccctgacactgtcccccacactgtccccacctgtccctgatgctgtcgtctgtgctgtccacatactgttggtgacctggctctgttctccaagttcaagcctcagagcaggcagtggtgaggccgtggcacctgggtggcctgaggggtggggcgggccttgggggcagggctgtggcctcgctcacccctgtgctgtgccttgcctacaggtgaagtggatcttctcctcagtggtggacctgaagcagaccatcgtccccgactacaggaacatgatcaggcagggggcctagggccaccctctgtggggtgtccagggccgcccagacccccacacaggagccgtgggccatgctcagccatcacccaggccacacctgcccccgacctcaccgccctcaaccccatggctctctggcctcgcagtcgccctctgaccctgacacgccccccttccagaccctgtgcatagcaggtctaccccagacctccgctgcttggtgcatgcagggcgctgggggccaggacacgctgctgcagccccgcggggggtgagggagacagcacctggggtgcagggcgggcagctgctgcatcaccggctctatcccaagcccaaggatggcgtcccagagatgcaggagagctttgtccagagaaggtgccagccctcagggaccctgctggagagatctccaccctctgcccttcaaggggccctacgggcctccaggtgctctggtggggtgggctccagtccactgtctgaggatggacggcctggccaggataaggaaaggaaacccaggacggtgccgggctccgggtcattccgtgcactgagcaggctgagttgggaagaagcagatgcttcctgcagctgctgccccctgcagggcctggcgcctggaccaggttcccctggggaaattgggcccctccctgagccacccggggcccacctcccactttctacctgggaccgagcatcctccagagggtcagccctcctgcgggaacaccatgcccagccccaggaccctccctcaactctccagcaaggctgcccctgcacaccccccagcagcccatgctgtgatgtaacatgacatcgtgtgacatggtgcccctgccccacgtgacccaagtgggct

SEQ ID NO: 466447 - DNA, 5964 bp, Homo sapiens
gtcgggaggaaggactgcttgtgtgcggggtgggggggggtggtggagagcgggggcggggattcagcgcgtgtatgtaaaggtgcagcccgtgtgctaggcgctgggtgcgcgcgcggtgtctgctcgggtgcgcgcgcgcgccgctgcccgcctgcccgccggcccgcctgctcgcctgctggggctgctccgtgggtttgacgggcgagcgggcgcggaggagctctgtccggaatcacatagataccatcgtggaaacagcagcgcaggtcacggcgccgcgggccctgcaccagacgctgggctctagagattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaacttctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaattgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagtggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaataaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagtaaaaaaaaaaaaaaaaaaaaaaaaaaaaaaaaaaaaaaaaaaaaaaagcatgcaaagagagaacactcgatagtatttgtaaattggtaacctttatggcctgcatcttgaaaccgctggatttataatgttaatttgtgcaaatacttgtttaaaatataacatacattacataactataaaataaatttgaacactttaagcattacctgtctatacataaaaatctaaaagaaaaaatcaacgtgagttagatagcatttgtgatgatctgaagaaatatgtgacgtttatcagaattaaacatggctcaaattaaactaacactagagtttgttctcagttacgtgaaacacccacaatccttcaaggttgtccaaaataagcagagtgcttactgtgtgagcgcacccaaagctatttttgtaacataattcatatttatgaagtactttgtatactaaataggaaaatatgtactccttaatatgtatttaatatgcctgacttgttttcctgatcacagtgaatttatcagttaatttgtaagagaaaaatcaagtaatgctgtaaaagctcatgtaaatcacagaaaagaactgttttaatgacttttgtttgcttttaataacatcaaggtattagaatttattaattgccatttttatgaaagtattaataaaattgtttgctacaatgatatttctgaagccacagtttgttaaatatatttgtctttccattatttttcagaaaaatataaagcagtaaccaaactgatcatttcacccagatttgagggtaagatatagctttagcctactgtttatattcaacttaactgctaaatctctgttaaaaaaaaacgctttctttagaaacatattttcaatctgtgttccttcccactggcagcccctttggagaagagtctgacagtgccaagatcaacatgctttgattcttgcccattcttttgaatcagttggattctgacataacttcagataagcaaatactaatattcagtcttaactatctgctcaaatacttttagaaacccttcagtacctctgtattccattgccagtttgcctggttacaggttagttacccacttatggagtgaattgtgatttgtatttggttcttttaaagatgaccaaaattatcaatccatgactttacccaaattattactgttgtggaaaatgaactaattgcattacggttaacttgagggcagaaatgaatgtaactgactatattgaccaatacggtgggtttaaggttcatatatttatggtaagaaaagtaaacacagaaacagagagagagagagaatataaattaagattgttgttgctttacacgtatacataggtatgctgaaggtgtgaacagtatagatagcatatgcaagtacttttagactaaatgccttatgcatctgaggagatacaccgtaggattgtgttattttatttatttatgagtactgagcacagagctttgggttccagccacttctgttatgtagacaagtggcatcaaatcaaggtttggcatcatttctagtgctcatcccattagtcactgtggtcagatgggctgaactaaaataaaatatcctgtttgtggcttcacttacctagaataactggtgacatatatcaagttcacctgataattgttaactctcaatttcagatttcctaaggatctattctttgttaatttaaaagctaatgggaactcaaatgaattttaataacttactttgtacaaaactgcccttaatctaatttggaattttattttgttttatttatttatttatttatttatttaatgtctttttagtttctactggttgataggattgtgttttaaaagggaaaatcgaggaagggaaattgtgttgtttatcttataggaaatgatggttttttttaatttttaaaaattattttaacctgttgttcttatgtctacaaggggaaaataaagtagggctctgaggcatttgaatattttagaccaaataattgctattgagaataaagattcaagcttctcattaatccataattgacatttccactgactgtaggacccagaaccaggagagaattactcaaccctccacttcagtttacttttgtagacactgcctaaatagaaatagaaattctggtgatttcaataacatcaaaaatgacaaattacctgtttaacttaaaaaggtcatgaatgaggccttcagagaaataatattaataatataatgaataaccatagagcagtgcctttaaattagctataggaaggaaatagtcttttcaagtttctgaacaatatatttctcttagttggcacctcacaaatactagatcatgtcagacgctgctggttaatagctgcaggaaggcatgttgtgcagtggatattgctcatggaagtgtgtgaaaatcatagtaagctttgttctccctgctaagacttgctatgtatatttccatcattgtttcatgtaaactgaaccattgtggtaaacttttggagttgatatggaatcactttaatgctgttttcacaaataaaagttttttcttataggtcacatttgtagccattcagtgtgtttattagtgtggaattagtaaagctcaagctcaaaaagaaatgcaaatagtctggtttttagctgatgcaatcaatatattagtttacatggctaggccagg

SEQ ID NO: 466448 - DNA, 2867 bp, Homo sapiens
  misc_feature (121)..(121): n is a, c, g, or t
  misc_feature (123)..(123): n is a, c, g, or t
  misc_feature (126)..(127): n is a, c, g, or t
  misc_feature (129)..(129): n is a, c, g, or t
atatgccaaacagcagtgttgaagggaggcagggctctggtttctcttttctgggttgaagaccctgagggagagagtcatgggggatgactgctccattgcatttaggctggtcgtcagngncanncnagtatctgcggtaaattggttccataagccccccgtggataccaaaatccagggatgctcaagtcctggagtcacgtgggatgcagaacccacggatgcaaaacattgtccctctgtattggtggattctgtattacatgaacactatattttgatcaacagcaggtcatttgttgcggtgactgagcctgtgcctgctggagcaatttcagctttagagggtatcctaagtccaggaccattatggctggttgcattgctcgactggaattctctggccactgaagctggcatagcactgaggtacagccatgtttatgaatcacagcaagaaggttcatctggaagtgaaggtgctttaactcagatcctcattcattgtgagattggaaaaacatgcacgtgcaggtcttgtcttaggtagcaataaaatgctattactaggtccccaaatgtaaatgacacaggcaactatttcataacatcaataaatctaatgtctgtgtggaggttgcagtgagctgagatcatgccactgcactccagcctgggtgacagagtgagactatgtctcaaaaaaagaaagaaagaaagaaagaaaaatttgaagtatagaggggaatcacaaaaattctaaatggtaactcatgtcaggaacctgaaagtcaagtcttcacttcagcattgggaagtatatgaaactgttttcggaccacacaactctgtgagctcatcgctaagaattggtatgcaaggtcttcagaagggtaggcaatttgtaaactccttttgacttagctggtaagacagaaagttcttttttcatggctaaatgatacttgagaaaagaaaaaatgtggtgaagctgaatgtatctagttgaaataaaaatgcctacctttctcctgcataggcaaaatatactacttacaagaaaaaaaggaatttatgaatagaaatagaatcaggtcacagtgcatttcctaattctccactggattttattactcaagcactgtatttttaccttttatcatagctgtcattcgtccttgtactttagatagcagcttatcaacccttgttatatccttaccttctttagggtgatgatcttatctttatttttgaccacacttcctgtgcctgccccttttcttacatcaatttctgttccacttgggattttgtactcacagatgtgacatgaatatttatgagattaaagtgaatggtccaacatcaattcagaaaaattttgatccattcgtccaaattatttaaaatattccctttctaattgaggcagcaaggcctctagcttagtgctcattttccctctctaagcatattcatgccattagggtattaatttcttctaaactaaagctcttatctcctcataattcattatgtctgtttttgattcgcactatcattgtggtctctcaacttactcccgttaacacagtcattttggtggcttttataatacctcctctgttgttcttcaaattttgcctaaataggcaataacttaaatgaaaaagtgttcatgaaactcgttaagtatgtaccagcacaccctgtaaggttgattgatgcttgatctaggtgtcttccgtatgctttgtgtgttactcctgtggctttaccagctattatgcattagtctctggggataagggaagtaataaacctttgtcccaggtctcataaatagcttggttattaatcaaatgatcatttggtctggcttcctttgttcggtcctatgcttgccacgccttcctgctttatcctcctcctgtatcccttcattcttcttctcctctttcctcccctcccaaactccttccttccctcattcctccactttcatctctttgctatttctagaaagaatcttttgtcttgctaggcagagcatttataacaaaggaaagacaggaggtgtagatgatgaagcagagtagagcacttttaactgcaagagtgttaggatatgaacactgctgttaggatagaaaagagaaaatcctcagacattttttttttccagagcaagagaaaatccagtgactgaaaaagaataagaagaaaaacactgaccaaggcaataattccaagaagtcaaaaattaaggcctgagaggaagaaggcagactaaagaaagtaggtaagacagtgacctgaacgaaagtgctggctccatgctctgtgacgttgggcgtcctcactgacctcggaagcatggtcttggtgacactggtcaggtgcatgaagtgttagaaaattttattaaagattccatggttgcatctctgccttcatgcctggatagttttttctcctccttctttcactcccagtccataacttgccaatccatttctataacctctttaaatataaataaagtctgaccattgtgaatagacccactttttatataatgaagaggaagttagggatatgctgagtttttgtttcattgttgttagtaatttaagatatcccttggtgttttctccatgtttcttgctggtttcattgcaactaagtatttcctctgtcccctactctctttcctctcctttgagaactccaatttcattaggcctatcccacccctccagtgggccatctgaaggtgtttcagacctcactggtgctctactcatattcgttcaaatctgctcttaatctcatcaagtatatttttcatctcagacatc

SEQ ID NO: 466449 - DNA, 2852 bp, Homo sapiens
ggactaactttcctcttctcgcggagcaccctatcccctattatcggcatctgatcttcctagttcggatccccggaacacacgccttctccagcctgcaatctacacacgtggggaagcgcgtccaagtggtgccaggaggcaggagggaagcgcaaaggttaatgcacaccaagtccacgtcctgatgcagcagcacctcatcaatgcggctagtgtagaaggggacactcatctccttggccagctcctccgcttcttcctgcgtgcggccccacagcgccttcaccgcgaagccctcgtctttcagcagcgggatgatgacacgggccgtgaggctggtgccgaacacgcccaccccgggaagcatggctgctcagagccgcctggttctgcttctgctcggatctccagtccaacgcgcgcacacacccacctctagccagtcctgcaccccgctcctgtagccaatctagccgcggtgcgccagccgccgtgcaccgggcaaggcgcccgggtgcccagagcgcaccgagctgcaggcggagcaagctcggggcgcctcagaacggtgactgcggcagtgtccgccacgcggggctcgcgtccttcccggagtcggcggcagggacccccccagggcgccggaggcttcgaagccccctggagccccggctcaggctgcgctcccgcggcagcgccagtccgctgcgtgcgccccgccaaggccgctccatggccggctcatccccgcggccgcgccgccgcagcccgggaccggctctctcccgcgtcgtttgcgcagccggcgaatcgcacagacaaacgtctacaccctgccagagcacggaaccgctccgcgggggagtctcctttctccctagctctccgttgggaatgaaataatcccgcggccgccaggaggccggctaaggatgcggcccggagcgcgccggactgggatcccgagctgcagcgcggcagcggcggccacgacccggcgccagcctcctcattctgctgccatgttcgctcgcctcgcggctcgggcggcctcggccccaggccggctcaggctctgggatcccgcggggacgagggcggagttggcgagtttggctgtcagcggccggtgttcctgcaccgccctcgctgcagcgccgcgcgccattggccgccgcgcgccgcccccgcccccgccgccgccagctccgggtgcgcgctgcgcccgggccccgggagcccagcccggctcctccccggccccgcccaggccgcctcgcccgcctcctgcccctccgcttcttccctttctttgccctcaccatctccttctcttccctgcttcactccaaaccccgccccaaccaagcaaatacatctatctaggcaggacgcgccctaataggttagtcgcctgtcccttggaagagagcagtgggcgccttggcctggggtaggtgaggggacccggcgaggtgcgaacagccgataataataacctcggctcccggagcgtttcttgcgtgctgagcatcatactaacgcctttccaggtattgtcccttttagtcctcgcagcaacctaaggttattgtaaacccattttaccagtgatgtgaatgagccgcaatgaaggctaagggacttgcgcaaggtgacatatataagcaacaggcctgcgattggaatccaggccccagagtctgggcacggaaccgcagacttctacggtctccttccaagctagcctgctccaatcgcgcgcccccgctccggccgcgcacgcacggttcagccgccttcttccaagacagtccagtcttggcgggctcccatctgcctcccacctcccccgcccctaggcccatgcccgcccccgcgtagacgctgtggtgtgtacggccgcagcggggcagggggtctccgaggccgctgcggcacgtgcgtctcgtgtctagtttcgagacggatacgtcgccctggccacatgccacgcccgcctcttgcttcggctcctgttgccgtcgccacttaccgcagcctttacttctcccagcttgcccccacctccaccaccctgcacccttcccaggccctcgagggggcactgaggaggactggccaaggctggccccgcacctctggagccatggggactctgcgtctgtctggttttccgccatatccttggcacctggcacactgccttgccctgtatgtaccaaccatcagcaaatcctgtctgctccacttgcagaatgcatccagagtctgcccacctctccctgccatggttggggagtccaagtcaccatcatcactatcaggaccactgtccttactggtctacctgcttccagtgatgcccctcccaatccatggctcttggagagcgggaatgcccttacatcaatgcataggagtttaggcatcacagaagcttctgagcaaaatacagaacttttctttttggtgtgtgaaggtctcagggtgcttggcctcttcatgcacacagcttctctggggtaatgctgttcagtgtacgtttctgctgcctctgtcagcctattaaggtgtgtagggcagatgatataattgcgctataaataaacagacagcaaggatggtgccctttccaggcagatcaataagcacataggaaaactatttagcgtcccaagtcattaacatgctgcttatacacacagatttagtgcaccagaaaaataacctttataacagtctggcagaaagtaaataaatactatttaaatttttaatttccagttgagagaggagaatgacatggcatctgcaattcaaattaagagtactattttaggcccttc

SEQ ID NO: 466450 - DNA, 2059 bp, Homo sapiens
  misc_feature (11)..(11): n is a, c, g, or t
  misc_feature (21)..(21): n is a, c, g, or t
tcatgtgctcnccccgggtantggctatcgtcgaacccaggcgctcgggcagccaacgacgtggagactcgcgggcccctttgcgaggttactacacgggttgcgccctccgaagtcttcggccttacttcccattagaacagagaaatgccatccacaggccaacaatctccctctgatgccgagccaaagctggactgtactgccatctcggctcactgcaacctccctgcctgattctcctgcctcagcctgccgagtgcctgcgattgcaggtgcgcgccgccacgcctgactgtttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggggtgcagtggcgtgatctcggctcgctgcaacctccacctcccagccgcctgccttggcctcccaaagtgccgagattgcagcctttgcccggccgccaccccgtctgggaagtgaggagcctctctgcctggccgcccatcgtctgggatgtgaggagcccctctgcctggctgcccagtctggaaagtgaggagcgtctctgcccggccgccatcctgtctaggaagtgaggagcgtctctgcccggctgcccatcgtctgggatgaagtgaggagcgtctctgcctggccgcccatcgtctgagatgtggggagtgcctctgccccgccgccccgtctgggatgtgaggagcgcctctgcccggccgcgaccccgtctgggaggtgaagagcgtctctgcccggccgccccgtctgagaagtgaggagaccctccgcccggcagccgccccgtctgagaggtgaagagcgtctccgcccggccggccgccccgtccgggagggaggtgggggggtcggccccccgcccggccggccgccccgtccgggaggtgacgggcgcctctgcccggccgccgctactgggaagtgaggagcccctctgcccggccaccacccggtctgggaggtgtacccaacagctcattgagaacgggccatgatgacaatggcggttttgtggaatagaaaagggggaaaggctagctgacagtttgtctattttattagtcgtttcaaaaaaaaaaaaaagccaaaaaacacctgctttaggggctgggtgggagggtccagtccagggtagaaaactgggttagttgagagtcggcagatgaagccagtgtgagccgaaggaaaggagcggcggaggcggctcagcggactcagccctgccaaggagaattcctagggcgggacctagagttttccgggccccatcttccgacgtcgccgccccggatgtcatcttatcctcctttgtctccgcctcccccctctcctcctcccgcgctgggctcgcggtgcctggttcctcttggagccgcttcttccgccgccgccgccgccgccgccgccgccgccgccactcggttcatcctcctgcaccagatggccaatcgagtgatcaggctgtacacagtgagccattatcgcactccatgggtctttttgttgctggtgcttatggccttcccatcatgtgttccctgtcgatgtgcactttctggtatggatagacacaggacacctctgtatgacctccctattgagcaaaagatgtatggagaatcaaaaattgaacacagtatgacatacattggccttatattgttaaagccatggagaaccataaggatgagcttaccaccatttctgtactggttggaactttcagaagagccagagacagaatatgagcaagacacagaagctacagtcttttgtaacctaactatgaaagtgacatctcatcatttttgccatggctcatttgttacaagcaagtcgctgggtccaacacaagaggagggatttacaagagggtgaatattgaagagatggtattccactgttttctacctttctgtgttgtagatttttaaaa

SEQ ID NO: 466451 - DNA, 3057 bp, Homo sapiens
tttttttttcttatgatatttttgtttgcttttgatatcaggccagctagccgcctttccacggggtagagtataaacagcaaacaaaaccgctttggtaccgggaggaaaaaggggaaaggagtcgagtcaaaacaccgtctcttaagttcctcaagatcaacccagggggaagggtcctccaccggaaagggccggattgccttcacaggaagggaaagtcactccggagctcgcagacgcgaatgccaccacagagttccaaggcggctgccagagcgtcggccgtcagttagcacctccccctccttcccagagctgtagctaagcaaccatcgggctccgggagagtctaggctcagctgctgtattagtgcctctagcggggaactatgagcgctgcaaaaccctatcaccatttttaccctcccctctctccaccccctttgcccccgcccacctcttcgccacttcggctcctccctcttctcgctccgtctatctctctctctctctctctctccgcccccccaccccccgcgtctctctctctctctctctctctctctctctctctctctctctctttttcctctctctctctctctcttctctctctctctctcactcactcactctctctctccctctccctctcctctccttcctcctccgcctcctcagctcttgggctagaatatctatgggtcgaaacgtgatgcgatgaattcgagagagagcgaaactaggacgaggagtgcggcggaagcggcgggactcccgggcatgggggcttcaccacaatagaggcagcgcccccacccgcccccgccagcccctccggagcgaagcccccaaaccccctcgggaaaaggatggcggcagcacctacccagatcgaagccgagctgtattacctgatcgctaggttcttgcagtctggaccctgcaacaaatccgctcaggtgctagtgcaggagctcgaggagcatcagctgattccgcgccgcttagattgggaggggaaagagcaccgaagaagcttcgaggatctggtggcagcaaatgcacacattcctccagactacctccttaaaatttgtgagagaattggtcctttactagataaagagatccctcagagtgttcctggggtacagacattattaggtgttggtcggcagtctctgctacgggatgccaaagactgtaagagtacactatggaatgggtctgcttttgcggctctgcatagaggcagacctccagaactacctgtaaattatgtgaaacctccaaatgtgggtgctgtctctcaaggcttccgttggctaggaaagggaaatcccctgaccccttgcacttccggcgtgaggcagtgccccaccctgcttccactcgccctccgagggctgcacccactgtccaaccagtgccaaagaaatgaaccagctacctctgttggaaatgcagaaatcacccatcttctgcatcgatcacgctgggagctgcagaccggagctgttcctatttggccatcttggaacagaatccacatgttttgtgttttaagagtggctgtagcatttgatgttcccactagccatgcattagtgatctagtttctctgcatccttgcctgcatttggtgttgtcaaagttttttattttagcttttcttgtgcatatgtagtgaaatatctcattgtggttttgatttgcatttccttgctggctcctgtatagtcagggacttaggaaaacttgcttcatcaacatggtccttagttttgttatatgtaaaatgagaagttgcattaagaatttatctttaacgtccattcaaggtttagcacaattctgtaagagattctagttcaaagagagaaaggcaaaacatgtttgcttgtaaactacttccgagagcctcagaaatggtgattatcccctcaatcttaactataaagttggtttgtatctttgaggtttgcatctttttattgccaaagtcagctgtatttttttgtctcttgcatttttttatcttgagaattaaaggacacaaagctcagttacattttaaatgtaaattctgatgaaaatttcattaggatatagtaaatgagtagaaatattgtttctaattgtacctgtgggcaaatgtgtcttcatgtggttgagtcaaatgcttatgatttctacaaaaatgggcctttctaatgcactttaaatttggattctgctattgatatctgtgtcccaataagaaatgatgtgatgtggagtatagatttcataaaaaatactgattttatctcagtatggaaccgttttttgacagattgacaaatagacaaggaagactcttaaatacctaagaaatctaattcaaatttattctaattaaatatgtaaaatattaaaccttaagtttagtataaaatgataactgctttacacctgattatcactttttgtctttcctcagtacctaacaatttttggcatctttgcctgctaattcaaattttttctgattaaatatgtaaaatattaaaccttaagtttagtataaaatgacagttgctttacacctgattaccactttttgcctttcctcagtatttaacaatttttgacttctttgcctgtcatataattgcttcagtgtgtttcagcataggcttcttgtgggtctttttattttggtctaataatctatttttcatgcatgaagataatagaaggttacaaaatcaaagtacaaaaattagtagcatttctgtacaccaaaagtgagcaagctaagataaaatcaagaagccaataatagctacaaaaaaacccccaaaatctaggaatatatttaaccaaggaggtgaaagatctctacatagaaaactacagaacacttaggaaattgtagatgacacaaacaagtagaaaaatagcctgtgctcatggactgtaaaaaacaatattgttaaaatgatcatactgctgaaagcaacctacagattcagtgtaatctccatgaaaataccaatatcattttca

SEQ ID NO: 466452 - DNA, 979 bp, Homo sapiens
tttgcatagtaacgaggagctaaatgttaatcaccaagacaatggggaaaatgtctccaggtcatgtcagacagctttgtggaagccccttccatcacaggcccagagacctaggaggaaaaaatgatttcctgagccaggtcccaggcccccttgctgtgtgtagcctagggacttggtgccctgtgtcccagctgctccagccatggctaacagggcccaaggtacagctcaggctgtggcttcagaggatgcaggccccaatccttggcagcttccacgtggtcttgagcctgcgggtacacaaaagccaagaaccgaggtttggaaaccactgcctatatttcagaggatgtatggaaacacctgaacgtccacgcagaagtttgctggaggagcagggccctcatggagaacctctgctagggcagctgcggaaggcggcgccatcggtcgccatggaaatcgcggcggatgggcggatcctgggcaggttggctgggtcgggctgcccgggcgacgccggagttgcagttggaggctgcgggaatacaaagtgacactgactgccgggtaactgtctctcaggacatttgtgctttgagtctctgcaactctggaccatctctgcaggctaaaagatgtgcctgttgctaagaggaggagccctgcagcaggaatccggtgccagctgacctggaacaacctgatctccagaaagcatccctgttatactcaaatgggccttccagatgagccctggatccagcctttctttgactatgaacctaaacgtaagaaagagaagtttcttgactccctaaaaacgagtcataatgctttctgaaactgagtctcttctgcttctggaaactgagtcttagtgcaaagaaatccctctgtattttcttgatttccatcttgattctctattttaaagataaaatagctgttgctttgtgtctgtgtagagtgtggc

SEQ ID NO: 466453 - DNA, 1035 bp, Homo sapiens
tgaactcaacaaataattgagatgctctgcaataagctctatattagaaaaaactcaaggttccagggatcagaggatagaatgatcaattctataagaggtggtggctgtaacggaataccatacagtgggtggcttataaacaacagaaatgtattgctcacagttctagaggctgggaagtccaagattaaggcagcagtagattcagtgtctagtgagggccccttcctggccccacctccaaataccatcacattgaggatttggtttcaacatgaacttggagaggacacaaacattcagactctagaaagccttactcaacatttgaaaattgaacttgatcctttgggcaacaggaaggaacatgatgagataaagactttagaatgataatccgaggttagaggacatgagaaaaatgcctaatgcagcacaggatacagattctccaaaaaactttaattgacctttcaacttccctttctcccttaaagaaagcagggctctgaatccccaagacaaagtgcatccagtattatatactgagaagagaaaatgaaccaagaataaggttctaccatggtgttgatatcagtacagtatccacagatgggagaaaaaaattcatctgccaaccatggctgtcagaactgcaagcatggggttaactcactgtccttcacaaataccctgccccataccaacctggcctgtctttccatcgcaagagtgacggtcaaatatggctgaacaggagcaatttcatatgaattacttcttagattaactgagcaaacaagattgcaacttgctaaaagccaaagtacttccacttccttcaaaagcaaccacttatgactgatttctgctcattaagccagactctcggaagatctctccttggcaatactttactagtttaaaggagccactggcaaaatatacttcaaagtaagcttccctggattggtcttccacaatgcagctgtctcactgattcatcctggcccctgcccactcctgtccatg

SEQ ID NO: 466454 - DNA, 1759 bp, Homo sapiens
tcatggcataaggcagagcaggagcaggcatctcacaggatgagaaggagccatagatgtagagagcatggactctggagccagccaggctgtttaaagttgggcaagtcaccttgcctctctggtcctcagtgtcctgatctacaaaatgggcaaaataatggcacttacatcttaaggcttttgtgtagaggaaacacattgatacacatggaaagtgcacagaacagtgcctggcacatagagtggaactggtggctttataagaaaaggaagagagacctgagtgagcatgctcagccccctcgacatgtgatgtcctttgccacctcagtactctgcagaatccccgccggcaagaagtccctgaccagatgcagcccctcaaccttggacgtttcagcctccacaactgtacttctgtcaagtccaaatcaagcagaatgggttcacttgtaagcaaaccacagaagggatcagccaccaacccaacagatgaacaacttgacttgctttccaatggagcccagcatttgaagctgtgataattgtcagtttaaatgttagctgtctatgtcctccaacagctcagagactcagagttgatgcgctggattctactgcaagttgcgtcttgataaacatagttactatgtgagccagcaaattccatttctagatatatacccaagagaaataaaaactcatgttcacaggaatgcttgtacacaaatgatcatagcagcatcattcataatagccaaagtgggagcaaaccaaatgtccatcaagcaatggatggataaacaaaatgtgatccagtcatacaatggaatattattcagccattaaaagaaatgaaatactgatctgtgctcaaacatggatggaccttgaaaacattaggctaaatggaaaatgccagacacagaagataggacacataatcagacacatgttgtatgattccatttatatgaaatgtacagaatgggcaaatccacagagacagaaagcagatgaatggtttccaggggctggggggagagggatgaagaatgactccttaatgggtgcagggtttcttgtagggtgaagaaaatattctaaaattgattttataatggtgattgcccaactctgtgaatgtactagaaaccacaggtagtacattttaaaatggttaagtggtaaatgtcttttttaaacattttattatcactatatatatcataaaagttattattttgaccactattaagtatgcaattcattgacattaagtacatttacaatattgtgcaactgtcaccaccatccatctccagaactttctcatcatcctaaactgcaactccatacccattaaatacttgctattactccctcccttcccccagcccctggagatttgttttgttttgttttgttttgagatggcatctcagtctgtcacccaggttggagtgcagcagtgcaacctcagctcactgcaacctctgcctccagggttcaagcaattctcctgcctcagcctcccgagtagctgggattacagggacacttgtgattgcatttagagttgacctggataatccaagatactctccccatctcaagacccttaactcaatcacatctgacagttacttttggcatataagaaagtaaagtttgaggaataagttgagggatcaaggataatatgcagttagaaggacaaccaaagtgtgaccgtaagtcagtgtgcctggggttc

SEQ ID NO: 466455 - DNA, 2383 bp, Homo sapiens
agggcccaccctgatggcctcctctacccttaattaccctttagatgcagtcattgacgtggtgacatcacgttttccctggtggcctgagcagggacacatgagggatggacattcttcttgtcctggctgtgctgtgggcccctccctctctccctctccttcctgcctgtgggtggtggtgggaggcaggggtgcggaatctaacctggctgccctgccctctgcctcgtgacctcaggggggttgggggctcctcttttgctcgcagcaggcaccccttgctcatctcctatggttgttgccttgtgggcaccccctctcccccgcagtggggccatctcattgcccttccccagtcgcgctaaggtgggctttgcctggaccttcacggtgcccctggaggctccagggtgtccctcaggtgcctgaggctgagtggcagtgtcgttcctgttcccagtgccccctcctacagtcgccgctgcagtgtctgtgtgtgggtcctggggagttttgagggggccgaggcggaaagtgaggcaccccctcccacacgggctgctgtgtgctccaggactgattgggacacctgccccctgctcccctttgccagtgagcacaggacatctgaggggatctgcaatgggaggggtctccacctgcagggaggaggcgctgtctgcagccacagcctgtggagcctgcagagctgctcaagtcaatgcacacccatgttggtctgctctgctgcattaccgacccttcaaggaggtggcctctcgtaatcacccacccaacaggagacagcaggagagtgagaaggacaaagtaagatcgctgctgcagatagagcggggctggcagatgactgatgtgggccccttgttgtacctccatctccataaagttgttctaggccatgtgggagtctcagaatcgctggtgctggtgcaggtgcagtgtggagagcctgtggaatgtcgtccgctcacagaccagcctgtgggggcagccggctggtcctcaggaaggccagggtgctcagaacagagattgccattccctgctgcactcctgccagcctccctgaggcgaggcacatcctgacgacagcccatgcgcatcagatgcctcctccatgggagtcaccaagggaaatccattctttccctgagacctctgtatgtcttgccaaggctccatgcacaggctgaacatgaactaagtctggcaagaaaaatgaggccgtggaaagcctgggagccattagtggagagcctcttaccaatctgtggaaatggctagcataattattaaatgaccttggaaggttggtggcaaactgatggaattattctgttaaataagagtgtgtccatattactgacattttatcatcaagaaaatggatatagaaaatatttaggggattgttaaaattagtgattatggcaatatggttttgtgaataaaattttgatttatgaagtattcacaaaaattatttcaaagatatttctttgaacagcaaaggtcaggagaagatttgaaaattaattagaaaaaattcctacagatcttcaatgtagaggccataatcaaaaaggaaagtttcttcggtagtatgttcgatacatcatttaattttaaaaattatcctgaagaagaaaagatccttaatgattactgtctaaacaaatttatagatcactgtttaaagtaaataagagcgaatattttcaaatgtgataaaataacacaagtgactggtgataaaatttgaaattatgcttaatctccttggctgtgatcttatgtatataaagttaaatttaaatatatgttcatatattgattacaaaatccagaataaatgtcattttattttaaaatagcacctttgtgtacaatgccatagcatttgtattattcagatggtttgtcagttaccttcatcttttttcctctctaagattgttttacatatgggactatttccccctccaaatagtcctaaatctaaacattttgcttcttgtccaaataaataaaaataatccagacatccaatttaaaaaattgtttctttcctagactaccttgtacaggaaatatcaccaagattctttgtcactccatcttccagatttgggttaaagaaaatggggtgattcacaacagatgtgagaattatgaacctcaaaggttgcccagttccttcctatttccccctgttcctaaaatgacagagcacttaggttttccctgcatttgggtaactggctgactgcaggctgtggaccttggccagatgggaggctgtagtgacagaggctggatgagaagccaggttccctctaacacccctaccccccacccc

SEQ ID NO: 466456 - DNA, 1350 bp, Homo sapiens
cattgatattaacaagaaaagtgctgttaggacaaataagtttgagaagtaggtttaacaaaatgaaagagtgtgacctcaccaattatcttcaggttcattctttcgattatgtgtatgaacttcagatggagagtgctgtagacaccaaggctctcttcttggccatgggtcagggagggtatcttcaggggctttctcagcctttctgtcgccaggaagtttcaatcctccagacaaagaaggagtcagcacgtaagccggactgtctaggaaaacctccccttcctgtgtctggaggtgttgaaaaaaataattcaacaatgctgcccctgctggccaccagtgtaccatgcaataattccatggcccctgccacagcccaggaaatggaggaaatggccaggcaggtcatcactggtatttggagacttgtggttgaacaggatcgagggatccattcccgcagtcactggtatttggagacttgtggttgaacaggatctctggaatgaatatctcagtggatgccaggcacgatgtttataacgttatattcactcacttataaagtactttcttaaatattttagctcctctacaaggatgtataatccttgaagcaggagctgttcccacccaagaaaatgaaaatctcagtcattaagtacacaaacacgggtccagattgcttggtttcaaatcttggttctgctactggccagctgtgtgatccaagaaaagctactcgacttctctgtgtcttcatctgctcatctgtcaaatggatatatgagtagtcctacttcatggagttgttgcgaggaatccattagtacctctcctagtgcctgcagccacgcaatacatatttgaaaagtaagtggaaatctgtcaagtgtaagttactgtgtggatattggtgtgatgcacagagaagaggaagcactggaagatgatcatggaagggagagaaggcaagcttgcaaaatcagcattggctatttaaataatatctgcctatgatgctgtcaaggaaaaatgttgtggagccgttggaaacgtgacattgaagctcaaaacagaggcctgaggggattgattaatttcccagagccgccataataaggtaccacaaactaggtggtttaaaacaataaacatttattgtatcacagttctggtggccagaagtctgaaatcagctacaatctgatttttcttgtgtttacagcaaaactgaaaagatttttttatattcatcattttcacatccttaccttccattttctcttgaacacacaacaattagacttagttgctgctgctccatagaaactgttcttgtca

SEQ ID NO: 466457 - DNA, 1134 bp, Homo sapiens
aataggagttattctataaaaaatgagcagcagcagattagtttgggatgcatcttcaggggatgctgaaacaacaacagcatttggtttcctctacacccctgtcatccgtcccccacaagcccagggagtgggagggccagagctctgggacatcctcctggcaagcttcaatatagctgtggaagtctgcagtctacaagagcctactatagacattctacaaccaagcagaatcatggaacagccgacttcaagcaccaatggggagaagaggaagagcccctgtgaatccaataacaaaaaaaatgatgagatgcaggaggcaccgaacagggtcttagcccccaaacagagcttgcaaaagacaaaaacaatagaatatctaacaataatagtgtattactacaggaagcatacgaaaataaattcaaatcaactggagaaggaccagtcccgagagaactccatcaatcccgtccaagaggaggaggacgaaggcctagactcagctgaaggatcttcacaggaggacgaagacctggactcatctgaaggatcttcacaggaggacgaagacctggactcatctgaaggatcttcacaggaggacgaagacctggactcatctgaaggatcttcacaggaggacgaagacctggactcatctgaaggatcttcacaggaggacgaagacctggacccacctgaaggatcttcacaggaggacgaagacctagactcatctgaaggatcttcacaggagggtggggaggactagtcaaacatggagaaaccaaattggacaaatcctcactaccaatggcgatgattacaataaaatcaagtttgaggagctgatgaccgtgtatatctctgcctgttgtctgatggtgggaaggaagggaagggaagaggtaggcatttgagaagggaaggatatgagatcctgtagggttggcggacagacccacaggttgacagtttcccagacattgtaaataaggcctgggggaggacttattcctagagacaaattttcttcttaaaattttatctaacaggagaggaagaaaaggacttggtgtttggagcatgtgaatatgtagaagggcatttaaaaagatctgtatt

SEQ ID NO: 466458 - DNA, 4037 bp, Homo sapiens
tgaccccgtggagtagaaagtttctctctctctctctctctgtgtgtgtgtgtgtgtgtgtgtgtgtgtgtgtgtgtgtgtgtgtgcgcgcgcgtgcgcgcatggggaatgcaagaaggtttggaccataagagatggagggaacaaaacctcacaaagacggcttttaatgaagaaatgggtcaggatatgttagctgagctaattcaggttatcatcctggctgctgatttactatgcaaagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacaatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaac

SEQ ID NO: 466459 - DNA, 1845 bp, Homo sapiens
cagctgactacactctgcaactgactgatggcacattgcataaagaaacgcgaacccagcagcactcctgccagcggcaattctgagtgctcatttccactttgccaagacattacatgggaaggcatgtgcgtttaagggcatccaattgtttctgtatcagaacagcagcaacatcccgggcaggcctttcctctggagttcacgtgtaggtcgtactgacacacaacatggcctaaatggaccatggaggaggaagggaccccaaatccaggccaaatgggagcagggttgtcctcaggaggaccccagctagaagactttctctggaacccacggtgcctctcactaaagtgccccaacgttggcacaacacctaccgaattgttgttgctgactctctatgcccatgattcaaccagaacaacattgattcgttaaaaggtgcatgaataaacttgactctggaaacaacaacagaactgtaaaaagatgaatttgtgtctttcaaactactaagttcattgtcatttgttacagcagcaagaggaagctgcaatataccctctgaccccctccttagccacctgcatttcagcctcaggagagcctaaaactagagccctgtttccgtcaagtattgctgggacatactggagatctgaaaatgttgttagccaataactaaggagaataccagggaactaaacagtctgacttgcaaagaacaaattctgctccctccccaccagcttgttccctttccatatgttgtctccagatactgacattctaacacattcagaacaacctatattaacacaaaagctacttcaggaaaaattaaaatacttacaagctctaacttttttcattcaaaatgaaaatagctttaccgggccctaggcagataatgtatgtttgtacagcatagagaactattagaattgagcaattcccatggggaaactggcatgttcagactctaaattaacatttggaagagttgcacagtagtaactgagaggcagctttctaatcttttgttaaagttcataaagagtgtctatgcccatttctcatttaaactttaaaacagtccaaagttaatgttattgagatgcctgctttacagctgggaacaacgaggctcttccaagattacagaaggggttagtgacttggattagactagatcagtttggtctgtttagtgcaatgttgtcatgtcgtctgagcacctgctatgtgccaggaacagttttggtcccaggtaggcagacagatatgggggccatattgccctctgccctgcacagactgtgtgggtatctcccaggcctatggggtcccccactttgttactctgagcagagtaaactgtgcagctctcagcagttccaagggggcagtttccctggaaccgacctcccactagaaccctcatggagcccccggcacggaccttagacctacctcacccacccacaggagcactgggactttgggataaggaaggggacttttcctctaagcctgtgggatctccttgaggaatccacctgcactcatcctaacccatctatgaaataaaaatcaaaagcagcgttcaagtaaatggggcccattcacaactgggggccatgaggaggactcatgcattaccttctttttataaccacagacatcttcatgttaaaaagagaaaaatcgaaacagagtaaacccagtcccttctgcctgctgggctccttccagggacctgcctttcccccccagtgacaggtgatacctgccccggcccccagttgatgtgacctctgccctagttggtgtgaccttcac

SEQ ID NO: 466460 - DNA, 2437 bp, Homo sapiens
gtggagaacgactgagctcctctgtgctttggtgacatggaaatggtccttccctctgcctctgagaagctgggctggaccaacccccatccgttcaccctttcgtttactcaaaaaatgcctgtgggtaccacagcaagcaaacagatgaaccccgccctggtggagatggtggactattggaggacacaggcagagaactggaagttacaacgtggggagactggatttgttggactggatgtagtattgggtgttgggttgtggggagatgcagagaaagtcaaagacaactctagggcttcaggtttggacaaatggtggagggagatgctgtccctgagacacagaaagaaaaagaaggtagttggtcttatacagaagaaggtctgtggtctcatgggaaggccatgtaaattgcacagagaagttgcatatttgggtctagagcagaagtcagcaaactctgaaaatggccaaggagaggatgttttttgtcttgcgggttgtacaatccttgctacaactactcacctccactgttgcagctggaaagcagtcacagatgatgtgtaaatcattggatgtggctgtattccagtaaaactgatttaccaagatggcacattgcataaagaaacgcgaacccagcagcactcctgccagcggcaattctgagtgctcatttccactttgccaagacattacatgggaaggcatgtgcgtttaagggcatccaattgtttctgtatcagaacagcagcaacatcccgggcaggcctttcctctggagttcacgtgtaggtcgtactgacacacaacatggcctaaatggaccatggaggaggaagggaccccaaatccaggccaaatgggagcagggttgtcctcaggaggaccccagctagaagactttctctggaacccacggtgcctctcactaaagtgccccaacgttggcacaacacctaccgaattgttgttgctgactctctatgcccatgattcaaccagaacaacattgattcgttaaaaggtgcatgaataaacttgactctggaaacaacaacagaactgtaaaaagatgaatttgtgtctttcaaactactaagttcattgtcatttgttacagcagcaagaggaagctgcaatataccctctgaccccctccttagccacctgcatttcagcctcaggagagcctaaaactagagccctgtttccgtcaagtattgctgggacatactggagatctgaaaatgttgttagccaataactaaggagaataccagggaactaaacagtctgacttgcaaagaacaaattctgctccctccccaccagcttgttccctttccatatgttgtctccagatactgacattctaacacattcagaacaacctatattaacacaaaagctacttcaggaaaaattaaaatacttacaagctctaacttttttcattcaaaatgaaaatagctttaccgggccctaggcagataatgtatgtttgtacagcatagagaactattagaattgagcaattcccatggggaaactggcatgttcagactctaaattaacatttggaagagttgcacagtagtaactgagaggcagctttctaatcttttgttaaagttcataaagagtgtctatgcccatttctcatttaaactttaaaacagtccaaagttaatgttattgagatgcctgctttacagctgggaacaacgaggctcttccaagattacagaaggggttagtgacttggattagactagatcagtttggtctgtttagtgcaatgttgtcatgtcgtctgagcacctgctatgtgccaggaacagttttggtcccaggtaggcagacagatatgggggccatattgccctctgccctgcacagactgtgtgggtatctcccaggcctatggggtcccccactttgttactctgagcagagtaaactgtgcagctctcagcagttccaagggggcagtttccctggaaccgacctcccactagaaccctcatggagcccccggcacggaccttagacctacctcacccacccacaggagcactgggactttgggataaggaaggggacttttcctctaagcctgtgggatctccttgaggaatccacctgcactcatcctaacccatctatgaaataaaaatcaaaagcagcgttcaagtaaatggggcccattcacaactgggggccatgaggaggactcatgcattaccttctttttataaccacagacatcttcatgttaaaaagagaaaaatcgaaacagagtaaacccagtcccttctgcctgctgggctccttccagggacctgcctttcccccccagtgacaggtgatacctgccccggcccccagttgatgtgacctctgccctagttggtgtgaccttcac

SEQ ID NO: 466461 - DNA, 2274 bp, Homo sapiens
cctacccccacctcccaccttaaagcaccttataccacggaaggctctcagcctcttctttcctctgcgaacgcgctgagcagcgattgaaaacgttttggtcctctgcaggtttgaacagggctagcaggtctctctccggatttctagggctatgggggcgcattctggggtctctgcgcaagaccagctctcagctctctctcctttcctcggactctggagcgggagcgggcctttccctcgggtcgaccacgccgtaggggacgccgtgaaaagagccgtcgcgcccgctgcctcctgcccgctgcgcagagggctccgcccgtagaggtcaacttccctcacccttttctctctcctgcttgccctccctccgcccggcccaggcgcttccagccccagactgtggccactggctgaggagtgcgagtcggctgcgctgccctgagcctaatccctcttccgggcccagacccgaggtccgcgctcctgggcagtggggaagctttagtgagcaggcttttctctccgcagcaaacttgtagccagaccagatgggccgcccagctctctcgggactaggcaggtgcggatgagttaatttttccgcattacaaagaaagatgacccagcccgcccttggactctcttttcccaaaatctcccaaccaaacccgcggcgttcatgcctggctttaagacgccaagataactctcttgttttggcattgtcgcaatgtccaaatcggtcaaaggagtgggataaggtgaaaggaccaggtagcagttccgcaccacgactttggagccaaagaaaaacccaggccgaaaaagcgagccttgatgtctttgttctgccttggcctgcaggggttgggaacaaaggagaggagctaagaggatgcaccaaagtagccgcgccctccctgcctggcgctgtccgcggtgctgaccgtggcccttttctctctccaaacataaggtcctcagccgcggattttagtgcttacttggtcaccaaagggacgtgcaatggactcaagtgtgggcctcgaggcttaactaggaaggggtgggtcggggacccaccaggtgaaacagggcaggagcccatgcagcttgccaccttcggccaggccttgcagcccggcagccttagtagacgggaacagcttgacccgttgagatactcaaggacaaccctccagggaaatagtatgtttccttcctgggaacaagatgctagcgcggtgcaccgggaggtatctggtgtcaacaatgccagagcgccctctgctgcctcaaagaggcaggacaccaccaggctgctgcctcgcagtttgatcttggactgccacgctagcactgagcaaggctctgtgggcatgggacccactgagctatgtgtgggatataatctcctggtgtgccatttgctaagacctttgaaaaagcacagtatttgggtggcagtgacccaattttcccagtacagtctgtcacggcttcccttgtctaggaaagggaaatcccctgacccctgtgcttcctggatgaggcgatgccccaacatgctttggctcgccctccatgggctgcacccactttctgaccagtcccaactagaggaaccaggtacctcaattggaaatgcagaaatcacctgtcttcggcatcgatcacgctgggagctgcagaccggagctgttcctatttggccaccttggaacggaccccacaactttcatactgattgttaagatgggtatagaatctggattagaaataacgtctttacaaaattttgagtgtattattccattgttttcttgcttccactgttgttgagaaatccaaaatagtttttaccccagatcctttgtttttgatattttttctctttctctagaaacttataggatcttgctttctcttcacaattctgaaatttcaaaatgatggcctttgttgtaggtcaatttttattcaaagttttcaaattttattgtgttgggcacttggtagacactttcaaactgtcaatttatgtctttcaggtctaggatgtttttgtgaattattttattgatgatttgtttctctttattttctatattgtctttttctggaatttctgttattgggatactagaatttctaaaaagtttctttaattgtctatatttttctgtttcattatttcttgctttactttctgggagattttatcaactttttatttttgcattttgactttttaatttcaaagca

SEQ ID NO: 466462 - DNA, 780 bp, Homo sapiens
acgccaaaagacatccagctagcacgccgcatacgtggagaacgtgcttaagaatccactatgatgggaaacatttcattctcaaaaaaaaaaaaaaatatcttcttcctgtcattggtagtactgaacgttagatatttttttccatggggtcaaaagagcaaggtggaagaattaaagaaaaaggaacacatgcatgagatattcaatgagatactaaggagaatcaacaggactaagccaacgggccatgaaagtaggaatggggtaaatagaactgctgctgttagaaatgtctgttgggcagagattgtggtggtgcccagggctgttgaggattttaattttccatttttattttatactcatttttccaattcatttccacttttgagcatgcccacagggacaccaagtttagagcaggctctacttgccagaaacttccttcatgtattaacttcaaaatctggccttagtggaaaaactgagttcagagaaatgacgaacgatttggtgactgctatgaaagaagtctgagaagttagcacatgtttggcagaatggactgaaactctgcagagtgaaaatctcagacctgaagttgtcttcatgaggaatttaaatgctaccatcatctccaatatttatgttaatgcaggcttcattgcacttgaaagttcagaaatttgagcatcaaaatgcaaagataccatagacatgaaataaaaatagtcacaaggatatttatatctaataaagttcaacaaccaagttatc

SEQ ID NO: 466463 - DNA, 629 bp, Homo sapiens
ccttctctctgaagatctgctagcagtgaatgcccaattcttctggactcatgaaccgtcgtgatgccattgccaaaacagatgccactgtggtggcattactgaagggagctggtgccattcctcttggcataaccaactgtagtgagttgtgtatgtggtatgaatccagtaacaagatctatggccgatcaaacaacccatatgatttacagcatattgtaggtggaagttctggtggtgagggctgcacactggcagctgcctgctcagttattggtgtgggctctgatattggtggtagcattcgaatgcctgctttcttcaatggtatatttggacacaagccttctccagacttcagctgtgaatccatctggtcgatgtcttttgtgcattggtgctccaggctgcagaccttccctgcactcaccattgaaggacataagtgtaagcccacaggtccagctttgcctttgcctcagagaatgcatggttcgggatcctgcagattgcacaaccccatccaccacttgaggcacctgagcactcttcctagggaactgagatttggcctaaacaccctgcaactaccacgtcaactggcttctacttggaagtgttagttg

SEQ ID NO: 466464 - DNA, 1862 bp, Homo sapiens
gggcaggggcaaaatggcaccagcctctttgctaaaacataacaagagtcacctttgctccagttcccaacaagttccttatctccatctgagaccacctcagcctggactttattgtcaatatcgctatcagacttttagtcaaagccattcagtaagtctctgggaagttccaaagtttaccacattttcctatcttcttctgagccttccaaactattccaacctctgcctgttacccagttccaaagttgctaccacatttttgggtatcttttcagcaataccccactcctggtaccaagttactgtattagtccgttttcatgctgctgataaagacatacctgagactgggaagaaaaaaaggtttaatgaacctacagttccatgtgactggggacacctcacaatcatggtggaaggtgaaaggcacgtcttacatgttggccgacaagagaagagagcttgttcaaggaaactcccccttatataaacatcagatctcatgagacatatttactatcatgagagcagcacaggaaagacctgcccccatgattcaattacctcccactgggtccctcccacaacaagtgggaattcaatatgagatttgggtggggacacaaccaaaccatattaaagcccatttttgttctcaggactagcttatgatctagttgggaagaaaaaaagttcacataatatggtccataagcaatgccagttggtagtattatttagagctattgagaaagggaagctctcttcctataagggctggtttttgagctggcagcaggtagacatagagtgtggtgagcactttgctatcatagggaaggagctatcattcaggaaagcaaagtccagcaatgaagagaagtgaattaaatggacaaaacagattgctgtggaacggtttgtgattgctattttgaaaacctggtcatatatttttagcctgcaaaacctctgctttgacacatttcctcatggggacacactgcagctgctgaaagaagggaagtcccagcactgctttctcaccatggaacagcaggagaggaaagccttttgaattctagccatgataaccctaaagtttacatggccacagactccagctttgccaggagaactttatttctgacacggattgtaacctgcagactgggaaacagagagcctctggctgagaccaaaagcaagcacttcaaaggaggaagagtggaacaggagttttatgctaaatggactggctaaatgtttatatttaacaggttacaggaagatgcatatttaacagattacaggaagatctatgactgttcatgaaatggggcctcacgcaggcataagcaaacatgcatgttacatatgtcccatatccactttggggtggaaacttaacattaaaatgtagtaaaattaggttttgtatctcaaaaggtgaaacttaggacacaaagtgtttagtgtgcagcttccataaactgagcagaactaatctgtagttggtggtcatttatcaggaagggatgctttgtgaaacctgtcagctgctatataaagactgcaaaaatgaaggggaggctggctctggcctcaggtggtttgttgaagtcagctgaggactgagttccattctttgttttccagggctggtttctgtttaactctcaggaaaaaaaaaaaaaaaaaaaaaaaaaaaaaacattctggcaatgcatgtggtcaaatcaagggtagagagatatgcagatgttcctgtgttattaggaacagagcatttctcaatagagctcatagatcagaaagtagcctgtgagttcccctttatcttacctgcaatagga

SEQ ID NO: 466465 - DNA, 2344 bp, Homo sapiens
aggtgatagtcccttcgtgtttgccaagatgtgtccagagttggttccttctggtgggttcctggtctcactgacttcaagaatgaagccacgggccttcatgctgggtaaaggccctgctggacaagcagttggagtgagaatcaagacagccggaccacaggaccagacccaccaggatccacatgacagtggatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgcttaacatgaaactgtctgcatttctacctgttagacaatggttgctcttgggctcttgttatacagtcatatggctacacgtttatgtaaagtttgcaaaagtttggtgttttgatttataataaaactgttatattattcaccttggatttttacttcatcctacttgaaattgtgcagctacataagtggtgtttctccaaattt

SEQ ID NO: 466466 - DNA, 1688 bp, Homo sapiens
tcagatctatggggaatggtcgatttctccctaaggatgtcagagtgtgtgtagctgccaacgtgggcatcaatattgaagtacctgacaagtgtcctaggagcccatactttatctggaagaaatatccagattatgacagtaaggccaaagacaggagacagatgatcaaagtggtaaaggcaccaacagttccatcttatactttgccaacatctgtagttccatgggtaattgaccaaactgattttggaatgcttggaagtcacttgaagcaactggacccaaatggtttccttatgccaaagccacacatcacccagatgcattcaagatcacggagactccttttgttataccttgtgtctgccatattctaccacgctgccaaattctactatgaggaattaccagaaatgcaaaccaatacctggtaggataccagagaaagcttagagatgcttacaggagagaattaactggtctatctaccttcatggacaagcactctgcacgcatgtggagtcacacaccgaatgctccaggcaacctctcagggggagagagaggtggttcaatcaaccaagacacactaaaaattcagggtatttctgaagatttaactcctaggaatttccacatcactgtcttccctgctgggcctgggaagaagcaaacaggcaacaccacaaggctatcttgaaagaattttggttttgggataaagcccaaaggcgagcctgcaaaccttaagccgtcacattcagaagatacagaagtagcaaaggtgtggagcccaagaccactccctggtgagcttcctgaggctcacctccatctgatgatctgcttcctggaaatcccatccatcctctgacagttagaaacatgtgattcacttgttcagtgaacatgctagtcaagctgctgttctaacatgaaatgggggccaagcacaggagtgtcttcagtaggaactgtacctccagaacttcaatttctacagaagattcaccgactgttcccccaaaaaacagtcctgaaatcatgcctaggagttaaagtgactaagaatgcagcacaggacccctgcacagataggccaggtagccaaaggttgccaatcattgcattactgatgctaaggattttattacttgaagaaaaccaggaataggctatttgcaaagattctaactcttgggaattcccatatcactatcttccaagatgccaggtgagccgtggaaaagcagacattcccatgagaccattttgaaagttgtcttgttcttggaataaagcccaaagatgaacctgtaagctgtgagatgttatgttctaaggacagtcaggcatgttgcagagcataagaatgatataaatggagtctggggactcaagggaagggggtgagggatagaaggctacacattgggtatagtttatactgctcagatgacaggtgcaccaaaatctcagaataaccactgaagaactcatccatgtaaccataaaccacctgttccagaaactaccaaaattttaaaaagggaagagtgctctacctgccacctactctttgtacttttctttctaaatatggtgttactagtgaaccatatttaagccatgcccacttttctcattcctttttaccatttcctttctcagtcctagcctctgca

SEQ ID NO: 466467 - DNA, 2398 bp, Homo sapiens
  misc_feature (2)..(5): n is a, c, g, or t
  misc_feature (12)..(13): n is a, c, g, or t
annnnctctttnngaaagtaggtcaaaagtgggggagagggcgaggccctttgacccccaggagtcacgcacgcatgccaagcgctactgcgcagccgcggagacgtggtccaggctcctgcccgggcctcattgtgcctcggacaacgagtgtacgcagttaccacacagttaccaagcagttacctcagagccgcggcgcagacgtaggcctcaggtctcgggcctcaggtctcgggcctcagagccagaccccgccatctcacgatgtcagagaggacccaggaacaggattttgttattataactgtcgacgacagtgatgataacaatgattgcagtattgagatggtggaagtttctgaaacagcagataattccactaatgacatagcagatgattccacttatgtcacagcagataatcccactgatgacacagccacacaaccaaattttccaggcggcaatgatggccatcaccgtccactccaaatgtcatatgggtctggctctgtcacccaggctggagtgcagtggcatgatcacagctcactgcagcctcaacctcttggactcaagcaattcttccacctcagccttcccagtagctgggatgacaggcgcacgccaccatgcccagtagcccatggtgaccaaatagtttcacagataaaccacccagtacatttaagaagatacagttacaactcagaggaagtggattttccaaaaagaggaagattctatactccagaggtacagtctagcatatcaccaccagcggaaaggcaggaaacccatgcctgggccagccctgctgtaacatctcttgagtcagcagcatgtcatgaactgcaggaagcagacctcagtgagagtttatcatatcccagaattgtctcctcaagttcattacagcagtatgtcgcacaaggtggctcatttccttgtttcggtatgccatggaactttatcagtggaggtgctgaaagtaccaatgctgtcatctcatttgccaatgctactacagcagtacctatggcagttctgtcacgaagagaatccagtctggcaaataaccctggtgtggtgaattactctgctctaccagaaaatgaaaatgtgggcccaggtagagccttgtcatctttctgcttccatcccaatttggctccagaggctgggaagttcaaaagcaaggtgccagccggtttgtgtggtgagggctgcatcctctgcaagagaggagcactgtgtcctcacatggcagaagcactgttacctctgaatattttggtaaaagtagacaccaacacggaaaacagcgtcaacacaatgaatcgctcaactttattggacagtgacagtggccaggattcttcctcatcatctgtctgtatccctcccaagtatggctatcttggtgatccaaaaagaaatgtcagagtacttaaaatccatttgctggccgtacaaaatatggccaaacctaagcaagcagcctgctacttggttcgtattttgttctccaaggaaatcctgattagcagctcagtggatatccatttgaaagacagccaatccctcgacccgaacaaaatggctgcattgagagacagagctacaaaatcctccaaggagcagcaggtcatgacagcttgcggaagaagccacccctttccttctttccagataaaaactgttcgcaaaaataaaaaacgtaccaaccgtgttgcatcggcatctgcagatagaaatgaccaaaggggcagagatggtggtgaaggctgttcttggatgtttcagccaatgaataactccaaaatgagagaaaagaggaacttgcagccaaacagtaatgctatccctgaaggaatgcgagaaccttccactgataatccagaggaacctggtgaagcatggaagttcctccaagaaaactacccaatttgtgatctctcggaaaatggaagagactggaagtcgtgtgtgacctccatcaacagcggtatccgtagccttagacatgacgtcagaagggctgaagccaggtctcagtcgcttccagcagtgacccctccagagctggagcaggagtcaaagccaggagatcccgacgccactgacccaagcacctgaacggcagctgccaaactttttttttttttttaactgttaagactattttttttgaagttatccattttatttctttctttatcacccatctcatgttctcattttcttttgccttttgaccatttatattgctgatacgatgttttctgcaaggctaattgtctttcctttgccaagaatatagtaaatgcatgataaatatttatcttgtggaataatgttcactacatatttgagggttgtattagtctgtttt

SEQ ID NO: 466468 - DNA, 5168 bp, Homo sapiens
ggaacgtccccgccccccgccccgggtgcatgcatggtggaaactccggcttgcagcgaaacagagcgctgcgcgcgggcgcgcagggagcctcgcggcccgggttgtttgtgtgcgcggacgtcaaagggggggcgcagataaagtgtggaaaccgggatgacttggaggggggaggggcaggaagccccaggagaacaaagctcctggccgtcggcctccaaagagtcgcagaagtgaccgccactggctcgtgcacaggcggaagcgggggagggcgggggacgccaggcctaaagcgcctcgtgggtttagagaactcagagagggcaccgggtgggggtgggaagaagactcaacccgtagctaaatgtttggcctttggctattttttaaggaaacgaatctcagggaggtcggggcgcgggggatgggggcatcatcgcgcctcggagatgggaagcgagttcccctccgctttctgggaaaagccttgtctcccttctttcccctccccccatcctgctgagggtttgcgttgacccatctctccgctcgggaccggcaggaggacggagccgcaggggctgaccgcggcccagaggctgcccaggggtcgcgctgctgccggcctgcgcttccgcactcccgggttcggtgcgtcgcctctcgcggcagcgcctcgcttcttccagactgtaattccacactcccgcaagcgctggggctgcggaatcgtttgagggagttggaactgcatcagatgagcacgccgggagacacgaaaattggacacgtggagaattagccctgctggagaagcgctgggtgcagactcaaacaatggtttccagcgccgaagctgaggcatcaccttccccacctccaccctcaaatggcagctgcctctatatacagcgggcacaccccttcactacccaccccctcccccaaagcctggttagggacctatgtgggctgcacgctctggagccccttgcccggacacaaaccctaggtgggcctgggctgcccgctgagtagctcattgcgcctgggatcccctgggatttagaagtatagggctctctatttttccctaggaaggtcctgtctcaaagatgccacccccaaaaattaatgtgtaaaaacccaaccaagctccagtctctgtgtcctttggcaaatctatctttcctagggcatactttcctaagctgctgggaccttgccccccatctgatgagccatacgcaggtggtctggcctcttcagagcagcttcctttagttattgtcttctccagaggccccatcctccacggcagccctaatcttagccccccagcctctctgagcccccatcccacccccacactgcgctgagctggcagcagccacagctcccccaggcagttcctctctcactgcgcggcctgtgcatctcgctggggcacacactccgcacagaagctccctcgcctcctggagctggtttcctcttacaggctccccttagagctgctggtgctgtgacaacgcctgcatctctgtgtctccctgcagcgctgcgagctgtgaatctgccttctcttcccttcctgcaaaggtcaagctgcctccttctctcgcagggccgcagttcagttctggcctgcagagcttctacactgcaacttgaatatgggaatggggtgggcatcgtgcaagggagcagtcacactcaagccaggaggcagggacaaaagggtgtgcgattcagggagggaaacactgaggacaaccctcagaaagcagtgcaggatttgcagctaaagactcaaaagagggagagaaaacgaggaaaaggctgttactaggtcgtgagtcctgaagtgtaggcctttctcctcccaccccgtgggttgccctaggggaaggccagaagaggcctcaggtgtctgcactgtgtcctgtgcagttcctagggccatgcacttccggtgaggctgcactttactccaagcaggagtcagaagcatggaattcagtggccgcaggagctcaagtcggctgcagccctttcaaagagggaccccgaagaggcctttctgccaccccagccccagagaggctatgaggctctacaagcagcagagagaatgatacggagaaaaatgagaggaaacgctattaaacttgcttcctctaaagagcgctacccaccgttttctctgaactgtacctaaaaagtcaggagagaactcgttaacttttgtttggtttaacattgccagcttcaagtcaaccgtaggccccccgaaggttttgtaaaatatttaatctagctcagacaatttcctgcagtccctaaccagaccaccccacttactgagccgctgccaaaaaggatgcttgactgcagactggcaaccagaggccttccagtcgcctggctggccttgacctccactcgaggcgccaggaaagacccttcccggaatcccgagagaccaagacctgggtaatcctggaggtctaaacccgtgaggaagcccaagaaatggagttaaagacccttttcgcacaaccgattgttgtctgtgtgaccttctgcggcccttgccctctctgaaccctctaaaatgggcatgaggatgtctcaccttcctctgggtgttatgcattttgaagcgtgggcactatgggagaggctgacgctctgtgttccccagcgccctccactcccaccccttcactgttttcttcgacattatctccctagagaacacagcaagcaggagcgggatccttcgactcggctgactctcaactccttccaaacgtgaggctgacggggagaactcctgctctgcccagtttccattcccgcctccagaataacgagccgaaaacatgtgtactgtaaataaagcctgtctaaataaagcactcgggtaaaggctaccgagaaaacactccgcatcgctctgtgctcagagcgtgagtcagcttcccagccccgggggaacaatggggaccttgccaagggtccccttctgtcgacccctgacggcccccaggcccgtttgggtggcgggagtgccggcaccctgggaccttcgggcccgaggttcgggagggctaagggcgctccaggcgaccagggttggggtccagccccaggattagcgcggccaggaatccctctgcccgcagctgccgcggaggggttgagggttaaacagacaccgggcagaggagcgagcctgccggctgcggccggcgcggcgcggcgcggggagaggacgggagggaagagggcgcacgctacctagcctcccgacgagaagacgtctcctccccacgtcaggccgggctctcgcccactcggctggccgcctctgctccctggcctctcaagtctcagcggaaagaaacgtagcggctgccaaaagcaccccactccttttattgtccccataagcctatacacgtacactagccacccccccaacacacacacacaacacgcacacgtgtgcgggagactcgaggatgccctgcctccatcgctcacagagtgagtaccaaggccgagcgaaacggcacccctttggtggaagacacagtgttgggaccagtggtggcctccgcgctacgtcttctatcgcaacctctgggtttcctttgcagaactgcataccccagagcagaggccatgtggagacctgcggcttggtcccgactggtgcagtggcctctgctctggtgtgggctggcggtttccccgcgcccggtgaccttaagggggtttccggagtcgcgcagccagcccttcctcccagcttctccggccaaggccgctctcggccgcccagcctggtcgggctcggctagtcggctcctcgccccgggcaggagtgcggttggtgaaagcactcggggcctcacccacgctctgtgcacacgcgccccgccggggcgggagccggagccgcgctccaacagcccgaaattgccaaatggtcgctgggcagggttggggatagactttgggaaccgggtttgagctggagaagacgaggaaaacgagtgaaacgggagaggcggggtggggtgacggctcataaatcatccagccccaccctcgggcctcagtgcagaggcgccctagccccacgaggaagaggaggttcacccagccactcctggccgacctctgagctctccgggagccagcgccccaccctaggctcaggccgcgctaggaccagctcccggcccagatcgtaaaccacccgccggaatcggcggaaagccgcccttggacacagcgcgcatccgcccaaggggaagtttatttatagcttgtaaacgtaaaggaaaccagaccgcgctacctcgccgcgctccggctgcttcgctccccacctgcccaccaggagggcgcgacgggtggagggaggtggggtttggttctgtgccccccctcccccgctcccgctccgctgccaggggagaacagggtcctaagaggctggcaagccttacattcctctcgggacgcctatccagtgccatgaaagccggagggggcggaggacagggcccgggcaccggagtggttagggtgggggtggccgagctggcccacttggcacggaagggcaggcaggccaggcgacgcggcgcgagattccacagctcccgctccggaccgggggaaatcctggagtgccagagagcccggggagggggcgctccgggagcctctccttgaaaggcgggatgctttccccgttcctcccgcgcacgtgtcctcagcagagcaggcaagcgctgcgcgcctggggctgcgatcctcgggtgacagcgactgagagcgcgccctctccacccccacccccgccgtcgccgcctctcctggggagctccagtctccagggtgcgctcggggcaggccccaagagccagagaaacggaaaagtgccggggaggcgattaggaagagaagacattaaaaagcccagccctgaaagacaggcagccgagctgaaaaagacgcctgcgaacccccaccccgccgcccctcgcctactgcgcccagacggcccctccttgtcccggctgagcgcacccacccccggcctcggccggggcgaattcgtgtgtgtgtgtgtgtgtgtg

SEQ ID NO: 466469 - DNA, 1660 bp, Homo sapiens
gagtcaaagaagattattttggaagtttaaggtttaatgactgccctattggatttcagatagcatggggcctcggggttccgggccgcgctgtgctatgaagcaggtcaatgagctgaaagagaagggcaacaaggccctgggcgtggaaaacatcgacaatgccttacagtgctactctgaagccattaagctggatccccacaaccacgtgctctacagcaactgttctgccacctatgccaagaaaggagactaccagaaggcttacaaggacggctgcaagaccgtcgacctaaaagaacgatgcctacaagaagaaagactgacagccttgaagcattacgacaaagccaaggagctggaccccagcaacatgacttacattaccaatcaagcagcggtatactttgaaaagggcgactacaataagtgttgggagctttgtgagaagtccattgaagtggggagagaaaacagagaagactatctacagattgccaaagtgtgtgctcgaattggcaactcctacttcaaagaagaaaagtacaaggatgccatccatttctataacaaatgtgctcaagaaatgccagcaggcagagaaaatcctgaaggagcaagaacggctggcctacataaaccccgacctggctttagaagagaagaacaaaggcaacgagtgttttcagaaaggggactatccccacgccatgaagcattatacggaagccatcaaaaggaacccgaaagatgccaaattatacagcaatcgagctgcctgttacaccaaactcctggattccagctggcactcaaggactgtgaagaatgtatccagctagaaccgaccttcatcaagggttatacacggaaagccgttgccctggaagcgatgaaggactacaccaaagtcatggatgtgtaccggaaggcgctagacccggactccagctgtaaggaggcggcagacggctaccagcgctgtatgatggcgcagtacaaccggcaccacagccccgaagatgtgaagcgacgagccatggccgaccccgaggtgcagcagatcatgagtgacatagccatgcaccttatcctggagcagatgcagaaggaccccccaggcactcagcgaacacttaaagaatcctgtaatcgcaaagaagatccagaagctgatggatgtgggtctgattgcaattcgacaatgacttgtccatccccgcttcccttcgccctcatgcggaaagaggagcggggaccgcggcaagcagcacggagcggaagggagagcagggggagagaaggcctcacctctctgtatttatacgtaagcccagggaaaacacggagatttgtacctgcgctgttcgtgctgccgctgcctctgggccctctcagcacatacatggtctcttcacagctgcccttgagttcagtgtctcctttccctgcccccagtggctgtctcagttgctctcccatagttggttattttttatttggggcagtgggcatgtatagggaggggagggggttcttcccagcctcaggtcccagctgtctcacgttgtttattccgcgtccccttctccaataaaacaagccagttgggcaaggttattaaaaaaaaagaaagaaagaaagaaagaaagaaata

SEQ ID NO: 466470 - DNA, 4050 bp, Homo sapiens
  misc_feature (2)..(2): n is a, c, g, or t
  misc_feature (9)..(9): n is a, c, g, or t
  misc_feature (11)..(13): n is a, c, g, or t
  misc_feature (21)..(21): n is a, c, g, or t
gnaccttgntnnntttctcangataccatctttcatctttacagtcatggccctcttctatgctctcatagcaagcactctgtgcattcttccatcttggtacatggttcagtggcctggtggccgaatcctgcatcgccatgagctagacaccttccttgcacaggcagtgtctacccagctttatgaaccagatcgactccaagaactcaagattgagaaactggatgcccgagggatccagcttgctgccctcttcatgagtggagtcgacacagctctgtttgctaatgatgcctgtggccagccagtcccttgggagcattgctgtccatggatttactttgatggcaagctgttccagagcaagctaattaaagcaggccgagagcgagtatctctggttgagctctgtgatggccagaagaagtttgcagacctttgtactagaggtatcaggatctccaatcttggatatgggggagaaggtctccatccaatcccaccccaaggaggaaaactggagattgctgggatggttgtgggccagtgggctggcagcagatcctccaggggccgaggatccttcggcatgcaagtggtttctgtcggtgggccaggaaaggggcatggaaaagaacagactggtagaggatccaagggacacaaaaaaggaaataagcaaggctcttcagatggagtttctaaatccctggagcttcatcaaggtcggtctcgctcccaggtaaatggaaacagtggcgcattgatcaaggaagagaagagtgatcatcgtcttccagctccatcacaatgtgccttatccagagacagcaatgagtgtaataatggtaaccgctacctccctatgaataatagggagaagaaccacttacaagagcaaaagctagaaactgtggcacaacggaaagaggactgataagctgaagatggcttcaccaaaccaggaagagggaaaaacttttacttttctgattttaggcccaagctagaggaggatataaatgcttaccctagatttctccaggattttggtgggatgtcctattgtgtccatcttttccccttccctgcctgtttctgggacttcagattcagtggtctgtttctggagaagttctggtcaaagatgaatggcagtaagactaggtcctagtctcaaattgaagatatagcaccaatagtttatttatctcctctgggagcctagtaaggcagtagctgtcagaaattgggtatcatcacataaggtcctatagaaaagctctagctttggtttttctgagcatttataatgatactcattatcaaagacttatatgataaacctatgaggttgtggggacagctgtggcctcctgaggtttttttttgttttttttttttctctatgaagtggtatctacctcttcttcactccttccaacttacctacccctggattttgtaccaccacctctagctttggcctgacaatcagataggtagatgttttcagaaaagtaaggtagtattggttattttaatttttattttttattttatacacttcaaaaaaactatcaatggcctttgtactgggggattcaagtgaatcagaaaagtactgggcagatttttcctgcctctcaaccagtgcattgtttgtaaaatagaagatgtggcacagttcattcactccctattgcccacaccatgaaagggtgggaatcagtgtaatgaacttgagaattgaggcttccagcctcatatacctccttttgggctttgtgatattcttgcccaagaagtaccatttctacagaaatacaactgactaatcttctagcagggttctttttgaaaaaccccatgcaccttaacccacagcaggtccttggtgatttttgcccagacaaccagaaggctatttgcttactgcccacttacaatgaccagatcataggaaattgaaaacagtgtcagactatttagtcctaatctgtcccagattaagagaatccatgattttcagggggagggagccctgcaatgccttgacccctgcccagatacttcttacataaaccaaagaaaaatgacaagagtgtacatctaaccagacagaagtagaaacaaagtatagaaaaacctcctctttggaatcagctcccttaatgtggtcccccttctcttggacctgcccaacctttcacaacgtcttgaaggaagcacttggacttaaaattgctaagatattttttgcagttgctatttctgtgcatcttgaatctatctgacacaatcaaatgacagtattgttaactctcacaccattaagaaaatttcttattttgtaggcattcactgtgagaggtaaaattgctgctttggcagattccaaattccctgcctttttggcccacctcaccacaaaagctccatagtttattaatttaacttctttatttgaatgtcctaaaggcacctttgtcttgacatttcccaaactgaacccatcctttctgtgcaagcctgtgcctctccatcagtgacactactttctactcaattgcctaaaccacagactgacctgggagtgaactgtcttagacttgtccctcacttctcaaatccagttgatgaaaacatctgttgataacacccaaccatttttctatttctcacatctgtttcctcatttctgtcctggctcctgtggcttagtggaggcctcatcgtgtcttacttggactgttgcagttgctccccgtcttactccttaactgggcaattttaagcaacattttatgtctaagtgtatgtacctttttccagtgaaagggcccataccttttttcaggttcttaaaggaatctgtgacacaaaaggatgttaagaaccattgctttaatccaccatgcttagtagcttctaaagtgtccctctaacatgctgctcccctgactccacggtcccttcatgatctggcacctgaccacatctcagctcatttactacctccgtactccagccataataaaatgcatcccatacacattgagctgtcaatatccatttcttctcacttgcttgtaccattgctaaaattcctttctccctttgtttctggtgcagacttaacttattgccccaagattcagctcgtgtctttatgattctttttctgatccccaattcggtgatgagtatagactcatcacagccagcccctctagtgctttgctgcatctttgcccctagattacacttgtgagcagtgactgtgcttaaccatctctgtgttcttggcacctactgcacagcacacacttagtaaatgtttgatgaataagtcaagaacagctaaaacacttttgaataagtcctttggtacaaagcagatttcagactttgaaggcagaggatatggtggcaaaaactcaggaagattgagtatgaggtttcagccctggatggtattcacttaaatgtgttttaaaattgagctctgagtcacctttgagcaatagagggatgctttgagcagagtctgaagccaggactctagggcattctttactgcttctgctgagtgactctagctgggcttggcctctctaaccactttgtgccttgtgtgtacagattctaaaaggaaacagctgagcctcaaggtgagcactagaggcctgctgaagcttgtaaacactttatccttaaatgaaaaattatttgtaacatcttttgtcttatatgggttcattatagctacagatgtcttttcctggcctttgatctttgagtgttgggactgtgaaaagttaatagaaggaaatatttagcatctggctttttaaaatgaatttattgcagacctattaggtaccaggcatagtactaaactctcatacattatttcttatccttaaacaactctccaaactagctctttttgttattcaggtctcagctcctgtcaccttctctgagaacccttccttgactaccttatctaaaatagactgctttcctttcaaatcattctct

SEQ ID NO: 466471 - DNA, 1173 bp, Homo sapiens
  misc_feature (1)..(1): n is a, c, g, or t
  misc_feature (26)..(26): n is a, c, g, or t
  misc_feature (28)..(28): n is a, c, g, or t
  misc_feature (40)..(40): n is a, c, g, or t
ncctagacgcaactgctctcttaatntnccaccgctacanctattgtaaaaggggttgagttcttgacttgattctccacttggtcgctgttggtatatagaagagctactgatttgtgtacattaatcttgtatctggaaacgttgttgaattattttatcagttctcagagctttctggaggagtccttagagttttcaaggtcctgcaggggcagtccacttccttcatagagtctgtggatcctcttgggattgctggtttgttcttgcagtcgatctggagctaaaattcaccatgcgagcctccacacactgctctgtctggagctgcaatctagtcctgcttcccatccgccatgatgatctctaccctcccaagagagaatttaattcagggaactgattatacaagagatggagaagccaaacaggagaattggagaacccaacagttttcaacatgaggaagtcactctcaactctaggctggaaagacaaagagaggagacagtgttattggagcccaggtgttgggttccataggatctcatgtcatggcgggctaatttgatgggcctagagtcatgaataatatgtagccattgaaggaaagccccacctgatgcagaagatggagaaaaactgtccgctccatcctcctgggttctaatctcctgtttttctgcctgttggttgaaccaagatggccacaaaatgttagctagtctaggaattgcaatcttcaggggtcagcctgtgtatattatgaggcacagcagaggataaatgagggatagctctcagggcaaataaatccattacaagcaaccactttgacagattaaatgagagtaatcatagctaaactgatatagaaaagtgttgaataatctatcccatctccatcccacatctttccaagcccaggctaggttaagcattcttttttgtgcttctacctccctttgtgttccccctctcaatatagcattaatttacaagctgtgtttgatagtttacttgtctgtatccttcatttgacaataaactctatgtgtgcaaagactatgtcatgtctcccactgtatccacagtgtctacatattgcttgaagtacagtgtgcactgtaaatatttgttattgaatcatttgatttgccaatgattctg

SEQ ID NO: 466472 - DNA, 3721 bp, Homo sapiens
cgtcttgctgataaaataggctgcagaaaggagccagccaaaagccaccaaaaccaagatggcaacgagagtgacctctggtcgtcctcactgctccagtcagcttggattagcatgctgccagagctctaaggttagaagcaaaaccaagataagccttacatcagggatgtcaaatccagaccatgcagtcacttcttcctccaaaacacctgaatcaggacattcttcaccatggagcctggacaaggcctcagaaaccttcttaagtcagtgctccaggcgaccactaaaagtcaagactggtggagtcaatagtggtggaaacagcagaagctacagttgtcatggcagtggctgcagccccaaaaaagagggggtgctccatatggggccagcactgggaccaaggtggacattcacttacctgtccatccccaaagcccatccctctgccatctacacgaatagctactctctgacttgaattttgggacagagctaaggatgagctaaattattgacttggatgcaaaacactactactttacaaatcattgttggactgagtgtttaccccagttttaaagttcattctatcacacagaaacaattgattttattaaagccagtttgctttttgcaaaattgtgtaacagctgtttcaacataaagcacttgaagcacaaatattagataagcacatgtacagaagggaatggggtgtcagaaataaaatgatttagatatggtacttaaggaatattgaagtatgataaaataaatccttgttatgaatcatttctgagacccatagagatagatttgtgcctatgatatgccatatctcacactttgttgcgtctcccatagagcccagcacctagcatattctctttaatactggagtgctcagtaaaggtccggagctatacaaatagaaacatattctatgttcatggattggaagactcaatattgtcaaggtgttatttcttcattacttcatctatagcttcaatgcaaactctatcaaatgccaagtaaacattttgcagctatctcaagctgccaataaaatttgtacagaaatgctaataatttagagtagcctaaataactttgaaaaagaacaaagctgtaagatactatcagatttcaagatttattataaagctgcattaggcaatacagcatagtattgccacaaagaactccttgaaccaccactgcactgcacattcgttagcagttcctgggccaaatacattgttgatgttgtgagttgtctccgctgccttacgacccatttggaactcaaatgagaaaattgctctaatttgctttttgtctaacatcatttctgtagtctaaaataaacattaaataaacaacaagtaatatgtattttgcaaatattttctcccagtctgttgcttgtcttgtcatcttcttaaaagagttatttgcagagtaaattttcattttcatgaggcacaacttataaatcatttctcttatggatcatactttggtgtgaagggtgagaactctgccaagccctagatcctacagatttattcctacttattttttctaaaagttttataatttttcattttacagttaagttcatgatccattttagctaatttctgtataagttttaatgtttaggccagtgttcccttttttgccagtgaatgtccaaatactcaggtactatttattgaaaaagctcttcattccctattaaattgcttttgtacatttgtcaaaaatcacctggacatatttgtgtgggtctatttctgagtaggtatttctattccattgacctgtgttactatccctccaacagtctcatacagtgttcattactgtagctataaaataattcttgaaaatgaggttgactgatttttaccagttcatcctttttttcaaaattattttggttattctagtcctttgctttgccacttgaaattttataaccatcttgtctgtatttacaaaaaatcctggtgagatttttatggtaattatattaaaaatagatatcaatttggggaaaattggcgcctttaatatgttgtcttccaacccatgattataatatgtctctatatagatctggttttacttctttcagaaatgtttcatggctttcaacttggggattttgcacacatttgttatatttatatctaaatattttaatttggggtgctattgcaaattatattttaaaaattttaaatcccaaccattgattgctggtatatagaaaagcaattgacttttgtatattgaccttgtattctgcaacattgttagccttcttatcagttaagggagctttttgtagattcacttatgctttgaaaatagacaaacatgtctgcaaataaatatagttttatttcttcctttccaatatgtatgcctttttaaaaattttcttaatgcactaagacttccagcataggatagtagtgaagtgttttgtagttttccttgtagaggtctttggattccttggttaggtgtattcctaagtattttattttattttatttttgcagctattgtaaaaggggttgagttcttgacttgattctccacttggtcgctgttggtatatagaagagctactgatttgtgtacattaatcttgtatctggaaacgttgttgaattattttatcagttctcagagctttctggaggagtccttagagttttcaaggtcctgcaggggcagtccacttccttcatagagtctgtggatcctcttgggattgctggtttgttcttgcagtcgatctggagctaaaattcaccatgcgagcctccacacactgctctgtctggagctgcaatctagtcctgcttcccatccgccatgatgatctctaccctcccaagagagaatttaattcagggaactgattatacaagagatggagaagccaaacaggagaattggagaacccaacagttttcaacatgaggaagtcactctcaactctaggctggaaagacaaagagaggagacagtgttattggagcccaggtgttgggttccataggatctcatgtcatggcgggctaatttgatgggcctagagtcatgaataatatgtagccattgaaggaaagccccacctgatgcagaagatggagaaaaactgtccgctccatcctcctgggttctaatctcctgtttttctgcctgttggttgaaccaagatggccacaaaatgttagctagtctaggaattgcaatcttcaggggtcagcctgtgtatattatgaggcacagcagaggataaatgagggatagctctcagggcaaataaatccattacaagcaaccactttgacagattaaatgagagtaatcatagctaaactgatatagaaaagtgttgaataatctatcccatctccatcccacatctttccaagcccaggctaggttaagcattcttttttgtgcttctacctccctttgtgttccccctctcaatatagcattaatttacaagctgtgtttgatagtttacttgtctgtatccttcatttgacaataaactctatgtgtgcaaagactatgtcatgtctcccactgtatccacagtgtctacatattgcttgaagtacagtgtgcactgtaaatatttgttattgaatcatttgatttgccaatgattctg

SEQ ID NO: 466473 - DNA, 3027 bp, Homo sapiens
ggagactgcggcgcagcagcgactagtgggagtccgatgtgggagaggggctgcggccaccgccaccgccgccgccaccaggaaggcggaggacgcaggagccaagagcaagggacgccgccacggtcatcttcgcctgccccgccgccctcttagagacactcattgcctatggatcatcctctcccagcttttgcaagcaccgggctgctcgcccgctgattttcctcctccataggctcactgcggaggcaacggcgaggtgtccgatttgtgcacttgaggcccgcaatccgggacggtggggaatctgcgcctcctggccgggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcaggtacctgtaaatccctctctgtatcttatcaaatatgatggatttgactgtgtttatggattggaacttcacagagatgaaagagtgtcatcacttgaagtccttcctaatagagttgcatcatctagaatcagtgatacacacttggcagaaataatggttggcaaagcagtggaacatatttttgagacagaggaaggttccaaaaatgaatggagggggatggtcttagctcaggcacctgtcatgaacacatggttttacattacctatgagaaagatcctgtattatatatgtaccagctcttagatgattataaagatggtgacctccgcatccttcaagattccaatgattctcctctggcagagagggagccaggagaagtcatagacagcctggtaggcaaacaggtggaatacgccaaagacgatggctccaagagaactggcatggtcattcatcaggtagaagcaaaaccctctgtgtacttcatcaaatttgatgatgatttccatatctatgaacagctgttcttcatgggtgactgctgtgaaaccaacaggatggcctcttttctatttaatcctaagagtgggcataaggtaacagctccactcaaagctgttttaaatgaacaaaatattggactttgtgaacaaatatgatactttttctttctgcaattattggctagcaatcttattttactaaatctatactgacaaatttaatttggtccatttatttgagtttaaagactatttcaaactctccccagtgaaacagtcatgggccattgctatcctcaaaagaactaaatatataaatagcagctttcctcaaaaaagatgataaagtcttcttttccctttagagcataaatttcagtggcaggtaaaactattttagcaacaatatgctcacttcttccatgatatgtttttcttccctactaagttgaaagtttttctcagtttccatagccactcacaagtttttctctacctaactgaagttgccctcttctgctggtcattaggacattaacttttagaatgatttctgtttcagcctcttgttttgaaggcaggcttttaatttcctcagagaaattgcaatggaacgaaaatttgttctctcttttacatatgtacacttgtataagagatgtaatgtttttaaataaaatttttaattcatgcaaaagcatgtctctaacagtgtgaaggttataaagattaataatagtagaaatatccctgtaccaatcacacagaataattctagtcagatacagtttttgtaaggacaaaaaagaaaatagatctaaaaaggtaaataagagagatcattgcatagtcctttacagtttaacaaaggttgtttagaaaggacccgctccatacttatccgattctccattttccactgaatttcctttccaaacaatgtgcagtattctcaatatctatcaaaattccataaaagttatgactgccaatttatacaaactgtccaccaagatgttttctcccaaacgtcgcattctggagccaagccattaaagacttggactgtgacacagttttcattatgagaaccatacacattggtgtaattaccctcacctcccatttactaccctataaagggaatccctatggccttaggcttacacacacatctaggagctctaaggaccaggaaaagttaaaagtggaccaaccactcaataaggtggctcttcagacccttcagtgcctaccacgagggggaacaattccacaggaaatggcttaggcagagtcatcccaaacctaagctgcctctactggctagaaatcaactgtggagttccaaccaacagtaaccagccagccgtaccccaggctttcattctcataaaagactaaacttctgtaaacccaaaataaaattctaaggcccccccaaccatctgaatggacatcctcctctgccagggcactctaaaatttaacctgaaagactggttcaggatatggcagaaagtggggggatcggacctacctcattataccctccaacattaacataaacacagaccttaaatatgataagaaacattctaatgtattctctctgaagccatctacctggaggcaccatcaggatgatgaaactttggtgtctacaacctcttactataacccagacatcgcattttattgataataaccagttgccaatcagaaaatttttaaatctacctataaattgaaagcacccccccttccagttgtcctgcctttctggaccgaatcaatgtgtatcttaaatgtatttaaatgatgtctcatgtcttctaaaatgtgtaaaatcaagctgcaccccaaccgccttgggcacatgttctcaggatatcctgagggctgtgtcacaggccatagtcacttatatttgtctcagaataaatcttttcaaatattt

SEQ ID NO: 466474 - DNA, 2690 bp, Homo sapiens
ggagactgcggcgcagcagcgactagtgggagtccgatgtgggagaggggctgcggccaccgccaccgccgccgccaccaggaaggcggaggacgcaggagccaagagcaagggacgccgccacggtcatcttcgcctgccccgccgccctcttagagacactcattgcctatggatcatcctctcccagcttttgcaagcaccgggctgctcgcccgctgattttcctcctccataggctcactgcggaggcaacggcgaggtgtccgatttgtgcacttgaggcccgcaatccgggacggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcagctcctttgaataaacctgcccaccaccaagaacccatacatgactttcttttcattgtatcaaagtaatgtgtccaccggtgtgagcaccagcaactcacttcttcctcagacatctctaaagctggacaagattttgagggacaatatggtttccttcaccccacaccaatgttatgaatgagaccagcagaccaacagcaaacacctagaaggaacagctgttcttcatgggtgactgctgtgaaaccaacaggatggcctcttttctatttaatcctaagagtgggcataaggtaacagctccactcaaagctgttttaaatgaacaaaatattggactttgtgaacaaatatgatactttttctttctgcaattattggctagcaatcttattttactaaatctatactgacaaatttaatttggtccatttatttgagtttaaagactatttcaaactctccccagtgaaacagtcatgggccattgctatcctcaaaagaactaaatatataaatagcagctttcctcaaaaaagatgataaagtcttcttttccctttagagcataaatttcagtggcaggtaaaactattttagcaacaatatgctcacttcttccatgatatgtttttcttccctactaagttgaaagtttttctcagtttccatagccactcacaagtttttctctacctaactgaagttgccctcttctgctggtcattaggacattaacttttagaatgatttctgtttcagcctcttgttttgaaggcaggcttttaatttcctcagagaaattgcaatggaacgaaaatttgttctctcttttacatatgtacacttgtataagagatgtaatgtttttaaataaaatttttaattcatgcaaaagcatgtctctaacagtgtgaaggttataaagattaataatagtagaaatatccctgtaccaatcacacagaataattctagtcagatacagtttttgtaaggacaaaaaagaaaatagatctaaaaaggtaaataagagagatcattgcatagtcctttacagtttaacaaaggttgtttagaaaggacccgctccatacttatccgattctccattttccactgaatttcctttccaaacaatgtgcagtattctcaatatctatcaaaattccataaaagttatgactgccaatttatacaaactgtccaccaagatgttttctcccaaacgtcgcattctggagccaagccattaaagacttggactgtgacacagttttcattatgagaaccatacacattggtgtaattaccctcacctcccatttactaccctataaagggaatccctatggccttaggcttacacacacatctaggagctctaaggaccaggaaaagttaaaagtggaccaaccactcaataaggtggctcttcagacccttcagtgcctaccacgagggggaacaattccacaggaaatggcttaggcagagtcatcccaaacctaagctgcctctactggctagaaatcaactgtggagttccaaccaacagtaaccagccagccgtaccccaggctttcattctcataaaagactaaacttctgtaaacccaaaataaaattctaaggcccccccaaccatctgaatggacatcctcctctgccagggcactctaaaatttaacctgaaagactggttcaggatatggcagaaagtggggggatcggacctacctcattataccctccaacattaacataaacacagaccttaaatatgataagaaacattctaatgtattctctctgaagccatctacctggaggcaccatcaggatgatgaaactttggtgtctacaacctcttactataacccagacatcgcattttattgataataaccagttgccaatcagaaaatttttaaatctacctataaattgaaagcacccccccttccagttgtcctgcctttctggaccgaatcaatgtgtatcttaaatgtatttaaatgatgtctcatgtcttctaaaatgtgtaaaatcaagctgcaccccaaccgccttgggcacatgttctcaggatatcctgagggctgtgtcacaggccatagtcacttatatttgtctcagaataaatcttttcaaatattt

SEQ ID NO: 466475 - DNA, 2716 bp, Homo sapiens
ggagactgcggcgcagcagcgactagtgggagtccgatgtgggagaggggctgcggccaccgccaccgccgccgccaccaggaaggcggaggacgcaggagccaagagcaagggacgccgccacggtcatcttcgcctgccccgccgccctcttagagacactcattgcctatggatcatcctctcccagcttttgcaagcaccgggctgctcgcccgctgattttcctcctccataggctcactgcggaggcaacggcgaggtgtccgatttgtgcacttgaggcccgcaatccgggacggtggggaatctgcgcctcctggccgggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcagctcctttgaataaacctgcccaccaccaagaacccatacatgactttcttttcattgtatcaaagtaatgtgtccaccggtgtgagcaccagcaactcacttcttcctcagacatctctaaagctggacaagattttgagggacaatatggtttccttcaccccacaccaatgttatgaatgagaccagcagaccaacagcaaacacctagaaggaacagctgttcttcatgggtgactgctgtgaaaccaacaggatggcctcttttctatttaatcctaagagtgggcataaggtaacagctccactcaaagctgttttaaatgaacaaaatattggactttgtgaacaaatatgatactttttctttctgcaattattggctagcaatcttattttactaaatctatactgacaaatttaatttggtccatttatttgagtttaaagactatttcaaactctccccagtgaaacagtcatgggccattgctatcctcaaaagaactaaatatataaatagcagctttcctcaaaaaagatgataaagtcttcttttccctttagagcataaatttcagtggcaggtaaaactattttagcaacaatatgctcacttcttccatgatatgtttttcttccctactaagttgaaagtttttctcagtttccatagccactcacaagtttttctctacctaactgaagttgccctcttctgctggtcattaggacattaacttttagaatgatttctgtttcagcctcttgttttgaaggcaggcttttaatttcctcagagaaattgcaatggaacgaaaatttgttctctcttttacatatgtacacttgtataagagatgtaatgtttttaaataaaatttttaattcatgcaaaagcatgtctctaacagtgtgaaggttataaagattaataatagtagaaatatccctgtaccaatcacacagaataattctagtcagatacagtttttgtaaggacaaaaaagaaaatagatctaaaaaggtaaataagagagatcattgcatagtcctttacagtttaacaaaggttgtttagaaaggacccgctccatacttatccgattctccattttccactgaatttcctttccaaacaatgtgcagtattctcaatatctatcaaaattccataaaagttatgactgccaatttatacaaactgtccaccaagatgttttctcccaaacgtcgcattctggagccaagccattaaagacttggactgtgacacagttttcattatgagaaccatacacattggtgtaattaccctcacctcccatttactaccctataaagggaatccctatggccttaggcttacacacacatctaggagctctaaggaccaggaaaagttaaaagtggaccaaccactcaataaggtggctcttcagacccttcagtgcctaccacgagggggaacaattccacaggaaatggcttaggcagagtcatcccaaacctaagctgcctctactggctagaaatcaactgtggagttccaaccaacagtaaccagccagccgtaccccaggctttcattctcataaaagactaaacttctgtaaacccaaaataaaattctaaggcccccccaaccatctgaatggacatcctcctctgccagggcactctaaaatttaacctgaaagactggttcaggatatggcagaaagtggggggatcggacctacctcattataccctccaacattaacataaacacagaccttaaatatgataagaaacattctaatgtattctctctgaagccatctacctggaggcaccatcaggatgatgaaactttggtgtctacaacctcttactataacccagacatcgcattttattgataataaccagttgccaatcagaaaatttttaaatctacctataaattgaaagcacccccccttccagttgtcctgcctttctggaccgaatcaatgtgtatcttaaatgtatttaaatgatgtctcatgtcttctaaaatgtgtaaaatcaagctgcaccccaaccgccttgggcacatgttctcaggatatcctgagggctgtgtcacaggccatagtcacttatatttgtctcagaataaatcttttcaaatattt

SEQ ID NO: 466476 - DNA, 7493 bp, Homo sapiens
tccctatataattttacattagatgctatatgtggagagattctgccaagacagccatttgtcggtcagctcaggggaaaaccagttcagtcagttactttgtgttcaaagtttagcccaaggaacactgcttagcctcaggagcactcgaggtggcatagctctcaaaaaatgtaagaatgatgaggaagaggatctcaggactgaactcaaccttctgaggaagtactctttccacaaaaacattgtgtccttctatggagcatttttcaagctgagtccccctggtcagcggcaccaactttggatggtgatggagttatgtgcagcaggttcggtcactgatgtagtgagaatgaccagtaatcagagtttaaaagaagattggattgcttatatctgccgagaaatccttcagggcttagctcaccttcacgcacaccgagtaattcaccgggacatcaaaggtcagaatgtgctgctgactcataatgctgaagtaaaactggttgattttggagtgagtgcccaggtgagcagaactaatggaagaaggaatagtttcattgggacaccatactggatggcacctgaggtgattgactgtgatgaggacccaagacgctcctatgattacagaagtgatgtgtggtctgtgggaattactgccattgaaatggctgaaggagcccctcctctgtgtaaccttcaacccttggaagctctcttcgttattttgcgggaatctgctcccacagtcaaatccagcggatggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaagcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagacaaagaagatgaatcatcagacaatgatgaagtatttcattcgattcaggctgaagtccagatagagccattgaagccatacatttcaaatcctaaaaaaattgaggttcaagagagatctccttctgtgcctaacaaccaggatcatgcacatcatgtcaagttctcttcaagcgttcctcagcggtctcttttggaacaagctcagaagcccattgacatcagacaaaggagttcgcaaaatcgtcaaaattggctggcagcatcaggtgattcaaagcacaaaattttagcaggcaaaacacagagctactgtttaacaatttatatttcagaagtcaagaaagaagaatttcaagaaggaatgaatcaaaagtgtcagggagcccaagtaggattaggacctgaaggccattgtatttggcaattgggtgaatcttcttctgaggaagaaagtcctgtgactggaaggaggtctcagtcatcaccaccttattctactattgatcagaagttgctggttgacatccatgttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctaggcaagctatggcagagatggaagctgcaagcaagatggttatgatggaagtcgtggaaaagaggaagcctacagaggctatggaagccatacagccaatagaagccatggaggaagtgcagccagtgagggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatctgtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtcctccaacatgaagaaacaacatatattgcaattgctttgaaatcatcaattcacctttatgcatgggcaccaaagtcctttgatgaaagcactgctattaaagtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctatagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaatatctgtgtttttcagatttcattttttgtaaaatcagaaattaatctaaacatattcagtgataagttcatgtgtaacgacttaatgttaaaggttaaaaaaaagatttcacaaaatatacaactttcaccatatatataagcctgcaaaattagagtagtgaaagtcatgctagtccatcacccaaatatgttatagacgccatagacaggtgatgtttggtcacctatggtaactgctacctgatgaagagcataatttctgcatatccatcctcaataccatggtaaattctggggcaatagagaagcaacagaactgccacaaagtatacctcaatataattcctctagttctgcttctaaaatctgaggacagtgctagtgggaaaataattttcaaactacctggttaaccaaaatacaaaagcagctgactatgtgtgatttcataatagcacatttcttgacacttagtgctagaaatgaagatttggattttcctaacaacttacatcaagaatgtagtgtagctcattattgagaatttaggaaagcctgaatccattaattaaggaaataaatgtgactcacatttcttttactgtgacacaataatgtgatcctaaaactggcttatccttgagtgtttacaactcaaacaactttttgaatgcagtagttttttttttttaaaaacaaacttttatgtcaaattttttttcttagaagtagtcttcattattataaatttgtacaccaaaaggccatggggaactttgtgcaagtacctcatcgctgagcaaatggagcttgctatgttttaatttcagaaaatttcctcatatacgtagtgtgtagaatcaagtcttttaataattcattttttcttcataatatttactcaaagttaagcttaaaaataagttttatcttaaaatcatatttgaagacagtaagacagtaaactattttaggaagtcaacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagaagaaattatatctatacattaccttgtagcagcagtacctggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagcagaatcacatgtgcacacacacatacacatgtaaacattggaatgcataagttttaatattttagcgctatcagtttctaaatgcattaattactaactgccctctcccaagattcatttagttcaaacagtatccgtaaactaggaataatgccacatgcattcaatgggatcttttaagtactcttcagtttgttccaagaaatgtgcctactgaaatcaaattaatttgtattcaatgtgtacttcaagactgctaattgtttcatctgaaagcctacaatgaatcattgttcaaccttgaaaaataaaattttgtaaatcaaaaaaccaaacaaccacccccccaacccacccaaacaaaagacaacagcagctctcactaccacagaatacacaaacgacaagagaccacagcgccccgggaggcaaggggagagaaaaagaagaggacaaggagtaatgaggaaagtaatagaggggg

SEQ ID NO: 466477 - DNA, 4318 bp, Homo sapiens
ccgacgctcgggtttaaattcgtgcacgaggcaaggacattgccttttgcctcccgtcatgattctgaggcctccccagccatgtggaactgtttgaggcacagagctgtatatacaataacagtgaaattgatcccactactaattatgacaaaaatgatcttccacgtaaacaggtggtgaagctccttatggtcctgaccctacagttcctgtcccatgaccagggccagatcaccaaggagctgcagcagttcgtcgtcagtggcagccccatgcgagcacccgaggaagtcacaggtgcccaggccggagtgcagtggcgtgatctcggctcgctacaaccaccacctcctagcagcctgccttggccttccaaagtgctgagattgcagcctctgcccggccgccaccccgtctgggaagtgaggagcgtctctgcctggccgcccatcgtctgggatgtgaggagcccctccgcccagcagccgccccgtctgagaagtgaggagcccctcagcccggcagccaccccatctgagaagtgaggagcccctccacctggcagccaccccgtctgggagggctgtgaccgtctatgacaagccagcatctttctttcaagagacctctggacctgcagcaccaactcttcatgaagctgggcggcacgcactctccgttcagggcctgaacctgaggacccagacacggagcggtcggccttcatggagcgggatgctgggagcgggctggtgatgcgcctccgcgagcggccagccctgctggtcagcagcacaggctggacagaggacgaagacttctccatctgctggcagctttagaaagtagagtttgaacaactgactcttgatggacacaaccttccttctctcgtctgtgtgataacaggcaaagggcctccgagggagtattacagccgcctcatccaccagaagcatttccagcacatccaggtctgcaccccttggctggaggccgaggactacccccgcttctagggtcggtggatctgggtgtctgtctgcacacgtcctgcagtggcctggacctgcccatgaaggtggtggacatgttcgggtgctgtttgcctgtgtgtgccgtgaacttcaagtggcaggagcagaacccgaatctttctggggatagcttcacagatccaccgctgaggaggaaacagtgcagagcgagctgcccacagtgaggccctgctcctggtttacatgagctggtgaaacatgaagaaaatggcctggtctttgaggactcagaggaactggcagctcagctgcaggtgcttttctcaaactttcctgatcctgcgggcaagctaaaccagttccggaagaacctgcgggagtcgcagcagctccgatgggattagagctgggtgcagactgtgctccctttggttatggacacataactcctgggccagaggctaaaaccccgggacccctgctgtccttcccacagcttcttctcagagtctcagggcaaatcctttcgagcagcgcctcccagtggccagaagctgaaatgatggcagtagtgccacctggtgaatgaattggttctgtgacccgggaagctgtgcttggctctgatttcttttctggaggctcggaaacacttcctctcttcttctgttcttcacgccccatgcccctgctagcgtattactgttctgtgacttccctgtgacctctgcagtactcctcatcctgcgtttggtctccaggtgtcacctttctgccgtgttcctaacattttgattcctgtcttgaaaaaagcacctgctgcaccataagcccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtgacagctgcagcgggcttggctttgtgaagaaccgagtgtgtccaccgatgtggcagctgcagcgggcttggctttgtgaggaaccgagtgtgtccagggatgtggcagctgcagcgggcttggctttgtgaggaaccgagtgtgtccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtggcagctgcagcgggcttggctttgtgaggaaccgagtgtgtccagggatgtggcagctgcagtgggcttggctttgtgaggaaccgagtgtgtccagggatgtggcagctgcagcgggcttggctttgtgaggaaccgagtgtgtccaccgatgtggcagctgcagcgggcttggctttgtgaggaaccgagtgtgtccacagatgtggcagctgcagcgggcttggctttgtgaggaaccgagtgtgtccacgttggggggaacatcatacttgatacacacgtttttatttgcacaaagaaaatgctatttttggagccagagttttcatgtctgattgatggcgattttcttaagaaccagaactgctggcagaaagggagcacccacaagcttagatagccgatgtcttatcagagggcagtttgtggttcctgatttggaaattaacattctccaaacattccagtccaatgaaagttttatccgctttcccatataaaaactcttcccacgagagtgacttgattctcacaatcccgttggagtcgtgtgtgtctgccgatttgtctgctggcttgcaggggtgggcctgtgtccctggccaccgctggacctgtgggtttcagggctgggacccaggaccacaggcagagctctgttcaaccagagaggagaccgagtgtgctggcaggggcgaggggttttcggtggcccagccaaacaccaccttctctcaagggccctgtcctcatcccagaagtggttgttttcctcctgtggtctctgaaagacagaggcatggctctgggacagagccatgtggtgatgactgtaatgggagtatgcctgtctccaacaagagggctgtggctggaaggtcaccttaagaggcacccctgtcctttgatgtcaccctggaggcccagagtaactcttctggaagccccatcatgtccatgcccgacagcgtccattgttcccttttcccagagcccagagctgggtagagctgcaaggacaccgcctgcacagagtgcccggggctgggcattgcctgctgcaatgacaacatctggctggatggcagagagctgatggaccgtcgcgacgtcccagtccagctgggccactgtcaccctggggctgtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtaactgcaccaggcaatgagaagcagctaactgttgacatgccaacagcttgcacgggcctcaagggtgtcacgtggcatgaaagacactcatctcaggccacacaggattccattcatcgaacattcctgagacaacggaattctggtgatggagcacaggtcagtggtggccaggggccagctctgtgtggaggggagagagagaaatctcaagggcgctttcacaggaacattaaacacgcaatagaatgtgttggcaaagcgctgtgtgatctctccctggggacgtggagccagttggaagtggaagccacagcagctgaaagcctgaccttcagatgtcgcagggtgcacctggatgagtcacaggaagaaggctagaagactgactcttggccgcattagtcctggctacttagaggccacctgggtcatgggccagctccctggttgcactggtcagccaggattgcactggttaccagggcagccatggcaccaaggtttgatgggcttgccatctaagtggaaatgcagaatgtgcccat

SEQ ID NO: 466478 - DNA, 3819 bp, Homo sapiens
gcttaggagaggccgggttaatcggccgaggcgcccatctgagaagtgaggagcccctccacctggcagccaccccgtctgggagggctgtgaccgtctatgacaagccagcatctttctttcaagagacctctggacctgcagcaccaactcttcatgaagctgggcggcacgcactctccgttcagggcctgaacctgaggacccagacacggagcggtcggccttcatggagcgggatgctgggagcgggctggtgatgcgcctccgcgagcggccagccctgctggtcagcagcacaggctggacagaggacgaagacttctccatctgctggcagctttagaaagtagagtttgaacaactgactcttgatggacacaaccttccttctctcgtctgtgtgataacaggcaaagggcctccgagggagtattacagccgcctcatccaccagaagcatttccagcacatccaggtctgcaccccttggctggaggccgaggactacccccgcttctagggtcggtggatctgggtgtctgtctgcacacgtcctgcagtggcctggacctgcccatgaaggtggtggacatgttcgggtgctgtttgcctgtgtgtgccgtgaacttcaagtggcaggagcagaacccgaatctttctggggatagcttcacagatccaccgctgaggaggaaacagtgcagagcgagctgcccacagtgaggccctgctcctggtttacatgagctggtgaaacatgaagaaaatggcctggtctttgaggactcagaggaactggcagctcagctgcaggtgcttttctcaaactttcctgatcctgcgggcaagctaaaccagttccggaagaacctgcgggagtcgcagcagctccgatgggattagagctgggtgcagactgtgctccctttggttatggacacataactcctgggccagaggctaaaaccccgggacccctgctgtccttcccacagcttcttctcagagtctcagggcaaatcctttcgagcagcgcctcccagtggccagaagctgaaatgatggcagtagtgccacctggtgaatgaattggttctgtgacccgggaagctgtgcttggctctgatttcttttctggaggctcggaaacacttcctctcttcttctgttcttcacgccccatgcccctgctagcgtattactgttctgtgacttccctgtgacctctgcagtactcctcatcctgcgtttggtctccaggtgtcacctttctgccgtgttcctaacattttgattcctgtcttgaaaaaagcacctgctgcaccataagcccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtgacagctgcagcgggcttggctttgtgaagaaccgagtgtgtccaccgatgtggcagctgcagcgggcttggctttgtgaggaaccgagtgtgtccagggatgtggcagctgcagcgggcttggctttgtgaggaaccgagtgtgtccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtggcagctgcagcgggcttggctttgtgaggaaccgagtgtgtccagggatgtggcagctgcagtgggcttggctttgtgaggaaccgagtgtgtccagggatgtggcagctgcagcgggcttggctttgtgaggaaccgagtgtgtccaccgatgtggcagctgcagcgggcttggctttgtgaggaaccgagtgtgtccacagatgtggcagctgcagcgggcttggctttgtgaggaaccgagtgtgtccacgttggggggaacatcatacttgatacacacgtttttatttgcacaaagaaaatgctatttttggagccagagttttcatgtctgattgatggcgattttcttaagaaccagaactgctggcagaaagggagcacccacaagcttagatagccgatgtcttatcagagggcagtttgtggttcctgatttggaaattaacattctccaaacattccagtccaatgaaagttttatccgctttcccatataaaaactcttcccacgagagtgacttgattctcacaatcccgttggagtcgtgtgtgtctgccgatttgtctgctggcttgcaggggtgggcctgtgtccctggccaccgctggacctgtgggtttcagggctgggacccaggaccacaggcagagctctgttcaaccagagaggagaccgagtgtgctggcaggggcgaggggttttcggtggcccagccaaacaccaccttctctcaagggccctgtcctcatcccagaagtggttgttttcctcctgtggtctctgaaagacagaggcatggctctgggacagagccatgtggtgatgactgtaatgggagtatgcctgtctccaacaagagggctgtggctggaaggtcaccttaagaggcacccctgtcctttgatgtcaccctggaggcccagagtaactcttctggaagccccatcatgtccatgcccgacagcgtccattgttcccttttcccagagcccagagctgggtagagctgcaaggacaccgcctgcacagagtgcccggggctgggcattgcctgctgcaatgacaacatctggctggatggcagagagctgatggaccgtcgcgacgtcccagtccagctgggccactgtcaccctggggctgtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtaactgcaccaggcaatgagaagcagctaactgttgacatgccaacagcttgcacgggcctcaagggtgtcacgtggcatgaaagacactcatctcaggccacacaggattccattcatcgaacattcctgagacaacggaattctggtgatggagcacaggtcagtggtggccaggggccagctctgtgtggaggggagagagagaaatctcaagggcgctttcacaggaacattaaacacgcaatagaatgtgttggcaaagcgctgtgtgatctctccctggggacgtggagccagttggaagtggaagccacagcagctgaaagcctgaccttcagatgtcgcagggtgcacctggatgagtcacaggaagaaggctagaagactgactcttggccgcattagtcctggctacttagaggccacctgggtcatgggccagctccctggttgcactggtcagccaggattgcactggttaccagggcagccatggcaccaaggtttgatgggcttgccatctaagtggaaatgcagaatgtgcccat

SEQ ID NO: 466479 - DNA, 4300 bp, Homo sapiens
ccgacgctcgggtttaaattcgtgcacgaggcaaggacattgccttttgcctcccgtcatgattctgaggcctccccagccatgtggaactgtttgaggcacagagctgtatatacaataacagtgaaattgatcccactactaattatgacaaaaatgatcttccacgtaaacaggtggtgaagctccttatggtcctgaccctacagttcctgtcccatgaccagggccagatcaccaaggagctgcagcagttcgtcgtcagtggcagccccatgcgagcacccgaggaagtcacaggtgcccaggccggagtgcagtggcgtgatctcggctcgctacaaccaccacctcctagcagcctgccttggccttccaaagtgctgagattgcagcctctgcccggccgccaccccgtctgggaagtgaggagcgtctctgcctggccgcccatcgtctgggatgtgaggagcccctccgcccagcagccgccccgtctgagaagtgaggagcccctcagcccggcagccaccccatctgagaagtgaggagcccctccacctggcagccaccccgtctgggagggctgtgaccgtctatgacaagccagcatctttctttcaagagacctctggacctgcagcaccaactcttcatgaagctgggcggcacgcactctccgttcagggcctgaacctgaggacccagacacggagcggtcggccttcatggagcgggatgctgggagcgggctggtgatgcgcctccgcgagcggccagccctgctggtcagcagcacaggctggacagaggacgaagacttctccatctgctggcagctttagaaagtagagtttgaacaactgactcttgatggacacaaccttccttctctcgtctgtgtgataacaggcaaagggcctccgagggagtattacagccgcctcatccaccagaagcatttccagcacatccaggtctgcaccccttggctggaggccgaggactacccccgcttctagggtcggtggatctgggtgtctgtctgcacacgtcctgcagtggcctggacctgcccatgaaggtggtggacatgttcgggtgctgtttgcctgtgtgtgccgtgaacttcaagtggcaggagcagaacccgaatctttctggggatagcttcacagatccaccgctgaggaggaaacagtgcagagcgagctgcccacatttacatgagctggtgaaacatgaagaaaatggcctggtctttgaggactcagaggaactggcagctcagctgcaggtgcttttctcaaactttcctgatcctgcgggcaagctaaaccagttccggaagaacctgcgggagtcgcagcagctccgatgggattagagctgggtgcagactgtgctccctttggttatggacacataactcctgggccagaggctaaaaccccgggacccctgctgtccttcccacagcttcttctcagagtctcagggcaaatcctttcgagcagcgcctcccagtggccagaagctgaaatgatggcagtagtgccacctggtgaatgaattggttctgtgacccgggaagctgtgcttggctctgatttcttttctggaggctcggaaacacttcctctcttcttctgttcttcacgccccatgcccctgctagcgtattactgttctgtgacttccctgtgacctctgcagtactcctcatcctgcgtttggtctccaggtgtcacctttctgccgtgttcctaacattttgattcctgtcttgaaaaaagcacctgctgcaccataagcccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtgacagctgcagcgggcttggctttgtgaagaaccgagtgtgtccaccgatgtggcagctgcagcgggcttggctttgtgaggaaccgagtgtgtccagggatgtggcagctgcagcgggcttggctttgtgaggaaccgagtgtgtccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtggcagctgcagcgggcttggctttgtgaggaaccgagtgtgtccagggatgtggcagctgcagtgggcttggctttgtgaggaaccgagtgtgtccagggatgtggcagctgcagcgggcttggctttgtgaggaaccgagtgtgtccaccgatgtggcagctgcagcgggcttggctttgtgaggaaccgagtgtgtccacagatgtggcagctgcagcgggcttggctttgtgaggaaccgagtgtgtccacgttggggggaacatcatacttgatacacacgtttttatttgcacaaagaaaatgctatttttggagccagagttttcatgtctgattgatggcgattttcttaagaaccagaactgctggcagaaagggagcacccacaagcttagatagccgatgtcttatcagagggcagtttgtggttcctgatttggaaattaacattctccaaacattccagtccaatgaaagttttatccgctttcccatataaaaactcttcccacgagagtgacttgattctcacaatcccgttggagtcgtgtgtgtctgccgatttgtctgctggcttgcaggggtgggcctgtgtccctggccaccgctggacctgtgggtttcagggctgggacccaggaccacaggcagagctctgttcaaccagagaggagaccgagtgtgctggcaggggcgaggggttttcggtggcccagccaaacaccaccttctctcaagggccctgtcctcatcccagaagtggttgttttcctcctgtggtctctgaaagacagaggcatggctctgggacagagccatgtggtgatgactgtaatgggagtatgcctgtctccaacaagagggctgtggctggaaggtcaccttaagaggcacccctgtcctttgatgtcaccctggaggcccagagtaactcttctggaagccccatcatgtccatgcccgacagcgtccattgttcccttttcccagagcccagagctgggtagagctgcaaggacaccgcctgcacagagtgcccggggctgggcattgcctgctgcaatgacaacatctggctggatggcagagagctgatggaccgtcgcgacgtcccagtccagctgggccactgtcaccctggggctgtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtaactgcaccaggcaatgagaagcagctaactgttgacatgccaacagcttgcacgggcctcaagggtgtcacgtggcatgaaagacactcatctcaggccacacaggattccattcatcgaacattcctgagacaacggaattctggtgatggagcacaggtcagtggtggccaggggccagctctgtgtggaggggagagagagaaatctcaagggcgctttcacaggaacattaaacacgcaatagaatgtgttggcaaagcgctgtgtgatctctccctggggacgtggagccagttggaagtggaagccacagcagctgaaagcctgaccttcagatgtcgcagggtgcacctggatgagtcacaggaagaaggctagaagactgactcttggccgcattagtcctggctacttagaggccacctgggtcatgggccagctccctggttgcactggtcagccaggattgcactggttaccagggcagccatggcaccaaggtttgatgggcttgccatctaagtggaaatgcagaatgtgcccat

SEQ ID NO: 466480 - DNA, 752 bp, Homo sapiens
gtggtgaagctccttatggtcctgaccctacagttcctgtcccatgaccagggccagatcaccaaggagctgcagcagttcgtcgtcagtggcagccccatgcgagcacccgaggaaggtgagtgagcacagacagatgggtcctggtgccctggagcagttcccgggtctcggctgccccaggtctcatagtgtggccatgctgggggaagcttaggtagtcacagtactggcctttttgggtgagtacactggtgacatgttactgtattcttgggctagtacactggtgacatgatgctatattcttgggtgagtacactggtgacatgttgctgtatccttgggtgagtacgctggtgacatgttgctgtattcttgggtgagtacactggtgacgtgttgctgtattcttgggcgtgtacactggtgacgtgttgctctatgcttgggtgagtacgctggtgacatgttgctgtattcttgggtgagtacgctggtgacacgttgctgtatgcttgggcgcgtacactggtgacatgttgctgtatgcttggatgagtacgctggtgacacgttgctgtattcttgggcgtgtacactggtgacatgttgctgtattcttgtgtgaatacgctggtgacatattgctgtattcttgggcgtgtacactggtgacatattgctatgttcttaggcaagtacattgttgacatgttgctgcattcttaggcaagtacgtgggtgatata

SEQ ID NO: 466481 - DNA, 757 bp, Homo sapiens
ccgacgctcgggtttaaattcgtgcacgaggcaaggacattgccttttgcctcccgtcatgattctgaggcctccccagccatgtggaactgtttgaggcacagagctgtatatacaataacagtgaaattgatcccactactaattatgacaaaaatgatcttccacgtaaacaggtggtgaagctccttatggtcctgaccctacagttcctgtcccatgaccagggccagatcaccaaggagctgcagcagttcgtcgtcagtggcagccccatgcgagcacccgaggaagtcacaggtgcccaggccggagtgcagtggcgtgatctcggctcgctacaaccaccacctcctagcagcctgccttggccttccaaagtgctgagattgcagcctctgcccggccgccaccccgtctgggaagtgaggagcgtctctgcctggccgcccatcgtctgggatgtgaggagcccctccgcccagcagccgccccgtctgagaagtgaggagcccctcagcccggcagccaccccatctgagaagtgaggagcccctccacctggcagccaccccgtctgggaggtgaggagcgtctccacccggcagccaccccgtccgggagggaggtggggggtcagcccccgccagccagccacccgtccgggaggtggggggcgctctgccggcgcccttctgggaagtgaggagcccttctgcccggccaccacgccgtctgggaggtgtacccaacagct

SEQ ID NO: 466482 - DNA, 4028 bp, Homo sapiens
ccgacgctcgggtttaaattcgtgcacgaggcaaggacattgccttttgcctcccgtcatgattctgaggcctccccagccatgtggaactgtttgaggcacagagctgtatatacaataacagtgaaattgatcccactactaattatgacaaaaatgatcttccacgtaaacaggtggtgaagctccttatggtcctgaccctacagttcctgtcccatgaccagggccagatcaccaaggagctgcagcagttcgtcgtcagtggcagccccatgcgagcacccgaggaagggctgtgaccgtctatgacaagccagcatctttctttcaagagacctctggacctgcagcaccaactcttcatgaagctgggcggcacgcactctccgttcagggcctgaacctgaggacccagacacggagcggtcggccttcatggagcgggatgctgggagcgggctggtgatgcgcctccgcgagcggccagccctgctggtcagcagcacaggctggacagaggacgaagacttctccatctgctggcagctttagaaagtagagtttgaacaactgactcttgatggacacaaccttccttctctcgtctgtgtgataacaggcaaagggcctccgagggagtattacagccgcctcatccaccagaagcatttccagcacatccaggtctgcaccccttggctggaggccgaggactacccccgcttctagggtcggtggatctgggtgtctgtctgcacacgtcctgcagtggcctggacctgcccatgaaggtggtggacatgttcgggtgctgtttgcctgtgtgtgccgtgaacttcaagtggcaggagcagaacccgaatctttctggggatagcttcacagatccaccgctgaggaggaaacagtgcagagcgagctgcccacagtgaggccctgctcctggtttacatgagctggtgaaacatgaagaaaatggcctggtctttgaggactcagaggaactggcagctcagctgcaggtgcttttctcaaactttcctgatcctgcgggcaagctaaaccagttccggaagaacctgcgggagtcgcagcagctccgatgggattagagctgggtgcagactgtgctccctttggttatggacacataactcctgggccagaggctaaaaccccgggacccctgctgtccttcccacagcttcttctcagagtctcagggcaaatcctttcgagcagcgcctcccagtggccagaagctgaaatgatggcagtagtgccacctggtgaatgaattggttctgtgacccgggaagctgtgcttggctctgatttcttttctggaggctcggaaacacttcctctcttcttctgttcttcacgccccatgcccctgctagcgtattactgttctgtgacttccctgtgacctctgcagtactcctcatcctgcgtttggtctccaggtgtcacctttctgccgtgttcctaacattttgattcctgtcttgaaaaaagcacctgctgcaccataagcccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtgacagctgcagcgggcttggctttgtgaagaaccgagtgtgtccaccgatgtggcagctgcagcgggcttggctttgtgaggaaccgagtgtgtccagggatgtggcagctgcagcgggcttggctttgtgaggaaccgagtgtgtccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtggcagctgcagcgggcttggctttgtgaggaaccgagtgtgtccagggatgtggcagctgcagtgggcttggctttgtgaggaaccgagtgtgtccagggatgtggcagctgcagcgggcttggctttgtgaggaaccgagtgtgtccaccgatgtggcagctgcagcgggcttggctttgtgaggaaccgagtgtgtccacagatgtggcagctgcagcgggcttggctttgtgaggaaccgagtgtgtccacgttggggggaacatcatacttgatacacacgtttttatttgcacaaagaaaatgctatttttggagccagagttttcatgtctgattgatggcgattttcttaagaaccagaactgctggcagaaagggagcacccacaagcttagatagccgatgtcttatcagagggcagtttgtggttcctgatttggaaattaacattctccaaacattccagtccaatgaaagttttatccgctttcccatataaaaactcttcccacgagagtgacttgattctcacaatcccgttggagtcgtgtgtgtctgccgatttgtctgctggcttgcaggggtgggcctgtgtccctggccaccgctggacctgtgggtttcagggctgggacccaggaccacaggcagagctctgttcaaccagagaggagaccgagtgtgctggcaggggcgaggggttttcggtggcccagccaaacaccaccttctctcaagggccctgtcctcatcccagaagtggttgttttcctcctgtggtctctgaaagacagaggcatggctctgggacagagccatgtggtgatgactgtaatgggagtatgcctgtctccaacaagagggctgtggctggaaggtcaccttaagaggcacccctgtcctttgatgtcaccctggaggcccagagtaactcttctggaagccccatcatgtccatgcccgacagcgtccattgttcccttttcccagagcccagagctgggtagagctgcaaggacaccgcctgcacagagtgcccggggctgggcattgcctgctgcaatgacaacatctggctggatggcagagagctgatggaccgtcgcgacgtcccagtccagctgggccactgtcaccctggggctgtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtaactgcaccaggcaatgagaagcagctaactgttgacatgccaacagcttgcacgggcctcaagggtgtcacgtggcatgaaagacactcatctcaggccacacaggattccattcatcgaacattcctgagacaacggaattctggtgatggagcacaggtcagtggtggccaggggccagctctgtgtggaggggagagagagaaatctcaagggcgctttcacaggaacattaaacacgcaatagaatgtgttggcaaagcgctgtgtgatctctccctggggacgtggagccagttggaagtggaagccacagcagctgaaagcctgaccttcagatgtcgcagggtgcacctggatgagtcacaggaagaaggctagaagactgactcttggccgcattagtcctggctacttagaggccacctgggtcatgggccagctccctggttgcactggtcagccaggattgcactggttaccagggcagccatggcaccaaggtttgatgggcttgccatctaagtggaaatgcagaatgtgcccat

SEQ ID NO: 466483 - DNA, 2308 bp, Homo sapiens
tttatatgtgcaggcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagaataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaaaggttgaatctttcattctgtcctccatgtcttttagcctctgtcatatttttcatctctctttgttcttaatactgggtaattttctcagatctattccccagtttaataattctcaggattctaatcttgccagtgattatgtccactgactccccctcatagtgaaatgagatagttccctttacaccttcacaggactcctgaaggcgttggctcatttactcagactgcagctctcaaccccttgtgggaggggggtgcacacaggttaaagtcctagaagtgaaattgctctatatgcacatttctaaatattttgataaatttagccaaattgcctgtcaaaaaggctcatattagtgcgcatttctttacaccctaagaaaccttgaataacatcatcctttttaatgatttacaacttaataaggaaaaataacattatatcatttttacaaattctataccttgacatacttagtgaggctgaacaatttaccatacatttattggctatttatgctcttgttttgaggtctatttattcttgtcttttgttaatttttctattagagtatttaattttttcttattgatttgtaaaaccttcttatatattaagaatagtaaagttagctatctgtaacatattttacaaacatttctcacaggactttttgtcttttaattctgtttagtatttttaatatgaagtttttatgttttgtagcatattcttaggttattcacttatttttattctggtggtattaagatttcatcttttacttttaactgtatccagctggaatttattttggaacaattaatttttggctttttaactctaaagttgaacattataaaatatgtttaaaacattcactgtcacactctgccttctcccatttaattttactatgaaatcatccataatttttgctgctagaagagcatttgatgatttgtaatatattataaagcaatggaatttgagtgcagtgcacttttagtcaattcccctgacaagataatttttaaatgtttctatttgactttaaaatacatttcacatatgtacatttcacacatacatgaataggtcttacactaaatttataccagtccgaatttcagaagcatcattattaacatccaacttgacagatgggaagcaaccagttttccttatcctgctaatctgtttaaacgc

SEQ ID NO: 466484 - DNA, 2097 bp, Homo sapiens
accctagcaacggagagacgccacgctctgcacagtctattttcggagcctagccagagacgggaaaactgaccaagataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaaaggttgaatctttcattctgtcctccatgtcttttagcctctgtcatatttttcatctctctttgttcttaatactgggtaattttctcagatctattccccagtttaataattctcaggattctaatcttgccagtgattatgtccactgactccccctcatagtgaaatgagatagttccctttacaccttcacaggactcctgaaggcgttggctcatttactcagactgcagctctcaaccccttgtgggaggggggtgcacacaggttaaagtcctagaagtgaaattgctctatatgcacatttctaaatattttgataaatttagccaaattgcctgtcaaaaaggctcatattagtgcgcatttctttacaccctaagaaaccttgaataacatcatcctttttaatgatttacaacttaataaggaaaaataacattatatcatttttacaaattctataccttgacatacttagtgaggctgaacaatttaccatacatttattggctatttatgctcttgttttgaggtctatttattcttgtcttttgttaatttttctattagagtatttaattttttcttattgatttgtaaaaccttcttatatattaagaatagtaaagttagctatctgtaacatattttacaaacatttctcacaggactttttgtcttttaattctgtttagtatttttaatatgaagtttttatgttttgtagcatattcttaggttattcacttatttttattctggtggtattaagatttcatcttttacttttaactgtatccagctggaatttattttggaacaattaatttttggctttttaactctaaagttgaacattataaaatatgtttaaaacattcactgtcacactctgccttctcccatttaattttactatgaaatcatccataatttttgctgctagaagagcatttgatgatttgtaatatattataaagcaatggaatttgagtgcagtgcacttttagtcaattcccctgacaagataatttttaaatgtttctatttgactttaaaatacatttcacatatgtacatttcacacatacatgaataggtcttacactaaatttataccagtccgaatttcagaagcatcattattaacatccaacttgacagatgggaagcaaccagttttccttatcctgctaatctgtttaaacgc

SEQ ID NO: 466485 - DNA, 599 bp, Homo sapiens
aacatagctaggtagaggccgggtgttaatcggccgaggcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 466486 - DNA, 565 bp, Homo sapiens
  misc_feature (38)..(38): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 466487 - DNA, 605 bp, Homo sapiens
  misc_feature (38)..(38): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctaaaaatataaacatacaaagaaatagaaaaagtcgtatcga

SEQ ID NO: 466488 - DNA, 1169 bp, Homo sapiens
  misc_feature (38)..(38): n is a, c, g, or t
  misc_feature (437)..(437): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 466489 - DNA, 1128 bp, Homo sapiens
  misc_feature (38)..(38): n is a, c, g, or t
  misc_feature (396)..(396): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 466490 - DNA, 1495 bp, Homo sapiens
  misc_feature (38)..(38): n is a, c, g, or t
  misc_feature (437)..(437): n is a, c, g, or t
  misc_feature (1276)..(1276): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctaaaaaaaaaaaaaaaaaaaaaaaaaaaaaaaaaaaacaaagggggggggggctcaaaaaatttaccccggaggggcccacattttgacggtgtacgcgctttcttgtncaccggggggcccaataaggggaggcgattttaacagcaagaaagggggcggagttttaaaaagcgtgggaggggcgaaactgtgtcacggggaacacttggggaagggacccctattggcggggggggcacaatcggggccaatatcctcgcagggatttaacgcctgaggaaaataaacttcggcggtatatgcgtggacacaaggaatattggcag

SEQ ID NO: 466491 - DNA, 1294 bp, Homo sapiens
  misc_feature (38)..(38): n is a, c, g, or t
  misc_feature (437)..(437): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctatacggtgtttgttttttggcctcaggtcatggcaaagtgtgcagcatgacagatttcagtgcaggcacctaagccgagttctcatgcagactcggcgctgtgaacctctttggaggtcatcttcc

SEQ ID NO: 466492 - DNA, 1297 bp, Homo sapiens
  misc_feature (38)..(38): n is a, c, g, or t
  misc_feature (437)..(437): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctactatagtgagtcggattaaagttcacgggcgcgcggttacaaggtccgggcggggcccgtgcgtaccaatttatcgctgcagaatccccttcgcagctgcgttggagagccggacgatgcctccacgt

SEQ ID NO: 466493 - DNA, 1136 bp, Homo sapiens
  misc_feature (38)..(38): n is a, c, g, or t
  misc_feature (437)..(437): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggaaaggcgtttaatagaaatgag

SEQ ID NO: 466494 - DNA, 1059 bp, Homo sapiens
ggggaaacctaggctaggtacgagggctggcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctaaaaaaaaaaaaaaaaaaaaaaaaaaaaaaaaaaaaaaaaaaaaaaaaaaaaaaaaaagagggggaccggcgacaaaaaaaaaaattaacaagagaggggagcaagaaatataaaaagataaccaacacatatcgtgtagcacgagaggaaagcaccaataaaagagagggcagatattaattaaacacaacagacgagaagcgcgaagataatataaaaaaagagtgaaaagaggagaaaaaaatagtgatccgtgagagaacataactggaggaaaagacaccccccaaacgacgggaggcgaggacacaaaccagtgagaccacacaaactcccaagaaaaaatatagacgacctgcggaggaacaaaataaaacactacagagcgataacaaggtgtcaacaacaagggaaaaacgaacgccagaaaaaaaatatgacacaagaaaaaaaaataggaaaattaagc

SEQ ID NO: 466495 - DNA, 584 bp, Homo sapiens
ttagcgctagtacgaggcctgcgtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 466496 - DNA, 1212 bp, Homo sapiens
  misc_feature (38)..(38): n is a, c, g, or t
  misc_feature (480)..(480): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcgagccccgccccgcgagccccgccccgcgagccccgccccgcgagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 466497 - DNA, 1638 bp, Homo sapiens
  misc_feature (38)..(38): n is a, c, g, or t
  misc_feature (437)..(437): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctaaaaaaaaaaaaaaaaaaaaaaaaaaaaaaaaaaaaaaaaaaaaaaaaaaaaaaaaaagagggggaccggcgacaaaaaaaaaaattaacaagagaggggagcaagaaatataaaaagataaccaacacatatcgtgtagcacgagaggaaagcaccaataaaagagagggcagatattaattaaacacaacagacgagaagcgcgaagataatataaaaaaagagtgaaaagaggagaaaaaaatagtgatccgtgagagaacataactggaggaaaagacaccccccaaacgacgggaggcgaggacacaaaccagtgagaccacacaaactcccaagaaaaaatatagacgacctgcggaggaacaaaataaaacactacagagcgataacaaggtgtcaacaacaagggaaaaacgaacgccagaaaaaaaatatgacacaagaaaaaaaaataggaaaattaagc

SEQ ID NO: 466498 - DNA, 1333 bp, Homo sapiens
  misc_feature (38)..(38): n is a, c, g, or t
  misc_feature (437)..(437): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctaaaaaaaaaaaaaaaaaaaaaaaaaaaaaaaaaaaaccccggggttttttggggggggggaaaaaggggtatggaaggggctgggaagttgttcgggaccccgttttttggtcagggggaaatcgggggggcccccaaaggggggcgattaattcgaaacgcggt

SEQ ID NO: 466499 - DNA, 1209 bp, Homo sapiens
  misc_feature (38)..(38): n is a, c, g, or t
  misc_feature (437)..(437): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctaaaaatataaacatacaaagaaatagaaaaagtcgtatcga

SEQ ID NO: 466500 - DNA, 1115 bp, Homo sapiens
  misc_feature (38)..(38): n is a, c, g, or t
  misc_feature (437)..(437): n is a, c, g, or t
tgggtccaagattattgattaatttgggcaccgcgagngctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcagccccgccccgcgagccccgcnccgcgagccccgcaccgccggccccgcaccgccagccccgcgagccccgccccgccccgcgcgctcctcgcattggccgagtccccgcggccacaccccctaccagattggggccgctattggacgctgcggccgcggccaatcggagccgctcttgctgcgacgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggggaacttcctgcgctagctgggcgggggaggggcggcctgccctcatctcatttctattaaacgcctttgccagcta

SEQ ID NO: 466501 - DNA, 982 bp, Homo sapiens
cggccgcatcgtttgacagatcgacaatgcccgtcttgctgctgatgactttagaagatcgaggctctcaagaaggagctgctcttcatgaagaagaacaacgaagaggaagcaaaaggcctacaagcccagattgccagctctgggttgaccgtggaggtagatgcccccaaatctcagaccttgccaagaacatggcagactcccgggcccaatatgacaagcttgctcggaagaaccgagaggagctggacaagtactggtctcagcaaatcgaggagagcaccagagtggttaccacacagtccgccaaggttggagctgctgagatgacgctcacagagctgagacatagagtccagtccttagagatcgacctggactccacgagaaatctgaaggccagcttggagaacagcctgagggaggtggaggcccgctatgccctgcagatggagccatcattgttattttcaaagattatctttgggagagtttgggagatatcatacttacatgtctttgagggcaagcaagttgttgtatgctggtttgcttattaaatcaggtaggcagttgttgcctacagaatgctcttggctccaggcatcagatggaggattgcagttacttacaggagaccagagctgaggaggaggaagaggaagaggaggagttcatcttgctatctcagggatggcataggtggaaaaaatcgacatggctacttgcatacacagaatacatcacaaataaacaatttttgttcagttagcatcaatttaactctaattttaatcaaaatgtatttagacaagagctatatattttctaagtgaatttaaatgtactgaaaaacaaaacaaatgataacgcgccaaataatatgcccgtattccagtgaacataatttaatggaattttcctcagttggcagctggattgacttataatcctcgctgtggtaaggtttttcaaagca

SEQ ID NO: 466502 - DNA, 804 bp, Homo sapiens
  misc_feature (791)..(791): n is a, c, g, or t
cggccgcatcgtttgacagatcgacaatgcccgtcttgctgctgatgactttagaagatcgaggctctcaagaaggagctgctcttcatgaagaagaacaacgaagaggaagcaaaaggcctacaagcccagattgccagctctgggttgaccgtggaggtagatgcccccaaatctcagaccttgccaagaacatggcagactcccgggcccaatatgacaagcttgctcggaagaaccgagaggagctggacaagtactggtctcagcaaatcgaggagagcaccagagtggttaccacacagtccgccaaggttggagctgctgagatgacgctcacagagctgagacatagagtccagtccttagagatcgacctggactccacgagaaatctgaaggccagcttggagaacagcctgagggaggtggaggcccgctatgccctgcagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaanttcagagttcaaa

SEQ ID NO: 466503 - DNA, 3605 bp, Homo sapiens
gtacctcagttgtccccatcatcatggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggagaccttccaagcccctagaaaggaaaatgctaacccccaagatgcccctgggccaaaagtttctccaacaccagaaccttctccaccagctactgagaaaatggcctgtaaagatccagaaaaacccatggaggcctgtgcctcagcacatgtgcaacccaagcctgcccctgaagccagtagcctagaggagccccatagcccagaaacaggggagaaggtagtagcaggagaggtaaacccacccaatggccctgtgggggacccactgagcctcttgtttggggatgtgacatccctgaaaagctttgattcattgacaggttgtggtgacataatagcagaacaggacatggacagtatgacagacagcatggcctctgggggccagagagcaaaccgagatgggaccaagcgaagttcctgcctggtgacctaccaaggaggtggggaggagatggccttgccagatgatgatgacgaggaggaagaagaggaagaagaggtggaattagaggaggaagaagaggaggttaaggaggaggaagaagatgatgacttagaatatctgtgggaaactgcccaaatgtatccacggcccaatatgaacctgggctaccatcccaccacatccccaggccaccacggctacatgctccttgacccagttaggtcttatcctggcctagcccctggggaacttttgactcctcagagtgaccagcaagaatccgcccccaatagtgatgaaggttattatgactccaccacacctggatttgaggatgattcaggtgaggccctggggcttgtccgcagggattgtctaccccgagacagctacagtggagatgccctatatgagttctatgagccagatgacagccttgagaactctccacctggagatgactgcctttatgacctccatggtcgaagctctgagatgtttgaccccttcttaaactttgagccctttttgtcctcccggccacctggggcaatggagacagaggaagaacggctagtgaccatccagaaacagttgttgtattgggagcttcggcgggagcagcttgaggcccaggaggcacgtgcccgagaagctcatgccagggaggcccacgccagggaggcctatactcgagaggcttatggcagggaagcctatgccagggaggcccacacttgggaagctcatggcagggaggccagaacccgagaagcccaggcccgagaggttcgttgtagagagactcaagtccgagagacccaggcccggcaggagaagcccgtcttagagtatcagatgaggcccttaggcccatcagtgatgggcctggcagcaggggtatcagggacctctcagatttcccaccggggaattacctcagctttccccaccactgcaagcagcgagccagactggagggacttccgtcctctggagaagcgttatgaaggaacctgctccaagaaagatcaaagtacctgcctgatgcagctcttccagagtgatgccatgtttgagccagacatgcaagaagcaaattttggaggatctcccaggagggcctaccctacttattcaccccctgaagatccagaggaagaggaggttgagaaggaagggaatgccactgtgagtttctcacaggccctggtagagttcaccagcaatgggaacctcttttccagcatgtcctgcagctctgactctgactcatctttcactcaaaacctccctgagctgcctcccatggtgacctttgacatcgctgatgtggaacgggatggggaaggcaagtgtgaagagaatcctgagttccacaatgatgaagatcttgcagcctccttggaagcctttgagctgggctactatcacaaacatgccttcaacaactaccatagtcgattctaccaaggcctgccctggggtgtgagcagcctccctcgatacttgggactgcctggcctgcaccctcgacctccacctgctgctatggccctcaacaggagaagccgctctctcgacactgcagagaccctggagatggagctctccaattcccacttggtccagggctacctcgagtctgatgagctgcaggcccagcaggaagattcagatgaggaggacgaagaggaggaagaaggagaatggagccgagacagtcccctttccctctatactgaacccccaggggcctatgattggcctgcttgggctccctgtcctcttccagtggggccaggtcctgcctggataagccccaaccagttggacaggccttccagccagtctccatataggcaggcaacctgttgcatacctcctatgaccatgtcaatatcactatcagtgccagagtcaagggcacctggggaatctgggcctcaactagctcgtccctcacacctacacctgcccatgggcccttgctataacctccagccacaggcctcccagagcatgagggccaggcctcgagatgtgctgctgcctgttgatgagcccagttgctcttccagttctggaggcttcagccccagccctctaccacaggccaagcctgtgggcatcacccatggcattcctcagctgcccagggtccggcctgagcacccccagcctcagcccactcactatgggccttccagccttgacctgtcaaaggagagggctgagcaaggtgcctctcttgccaccagctactcctccactgccatgaatggaaacctagccaatgtaggggaaagatagaaaatgagggtccatttatcacagccagcaagaaaggggatttcagaccatgcagagcttaaggtatctcagtttcttaaaagggaaaactcccttctcaagcctcccaacacaaaatgttccttaagccttgcccatcccatcatttggactctgtaataa

SEQ ID NO: 466504 - DNA, 3188 bp, Homo sapiens
ggctaatgatggtgttgttgatttcctagaacgagtacatcggccaacatgacgagaggcgtgcgaactgcagtggtgactatgaagaaagcagctgtctggaccgacagtcgctactggactcaggctgagcggcagatggactgcaactgggagctccataaggaagttggcaccactcctattgtcacctggctcctcaccgagattcctgctggagggcgtgtgggttttgaccccttcctcttgtccattgacacctgggagagttatgatctggccctccaaggctctaacagacagctggtgtccatcacaaccaatcttgtggacctggtatggggatcagagaggccaccggttccaaatcaacccatttatgccctgcaggaggcattcacagggagcacttggcaggagaaagtatctggcgtccgaagccagatgcagaagcatcaaaaggtcccgactgccgtccttctgtcggcgcttgaggagacggcctggctcttcaaccttcgagccagtgacatcccctataaccccttcttctattcctacacgctgctcacagactcttctattaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgatacccaaggagaaactcgtgacagacacctactccccagtgatgatgaccaaggcagtgaagaacagcaaggagcaggccctcctcaaggccagccacgtgcgggacgctgtggctgtgatccggtacttggtctggctggagaagaacgtgcccaaaggcacagtggatgagttctcgggggcagagatcgtggacaagttccgaggagaagaacagttctcctccggacccagttttgaaaccatctctgctagtggtctgaatgctgccctggcccactacagcccgaccaaggagctgaaccgcaagctgtcctcagatgagatgtacctgctggactctggggggcagtactgggacgggaccacagacatcaccagaacagtccactggggcaccccctctgccttccagaagtgctccctgctgcttccccggggatatttcaggccactgacaaggcctcagcccaagctgagcctcatcctattctggaaacatcgagggctggccagctggggcagaggcgagggcattgtctctgtgcaccagagggccctgggggtggagcagcgagctgccgtcatgctgcatgcagcaggccgactatggggcagacattgtgctggaaacacagagaggggaacaaaatgctgtccaggtctccaggagctcacagaggcatacacccgtgtgctgataggaaatattgacctgtccaggctcatctttcccgctgctacatcagggcgaatggtggaggcctttgcccgcagagccttgtgggatgctggtctcaattatggtcatgggacaggccacggcattggcaacttcctgtgtgtgcatgagtggccagtgggattccagtccaacaacatcgctatggccaagggcatgttcacttccattgaacctggttactataaggatggagaatttgggatccgtctcgaagatgtggctctcgtggtagaagcaaagaccaagtacccagggagctacctgacctttgaagtggtatcatttgtgccctatgaccggaacctcatcgatgtcagcctgctgtctcccgagcatctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtgtgcttgcatccagaggctccagccctgaccaagccttactgagtatccaaagatgggcctctgtttgctaaataatttgctccctcacctgctcaccccacaaagacaggtactactaataaaattaaagtcatcatcaccctcatcatcatcaccatcatcatcatcat

SEQ ID NO: 466505 - DNA, 519 bp, Homo sapiens
tctaggagaatgagagctcagaatactacgaagctttgctacaattgaaggagtggcttatagactccagctccatatgctgatgacaatatttttgaagccatcaaatcaatcctatactcactgagaggctcaagaagagtgagatggcatccattgagaatgaagaccaccttggtaaaaaagaacagagactttacatctttgtaccgagatgctgctgacaaagcttgtggacaataagtcatgggtgatcaaccaaaactgagccttagaaatacagggttcatttagaaataagtatttttttctttaaggttcttaggcagaaaaggattggcaaaaataaatagaacttctttgctgagaattatgctctactgaatcattttcagtcatacctccataaacaactttgttttaaagccccagacactgtctgtgaagcccagaacaattgctttgctgtcccttcaggaacagcaactgctgcctctaccaacaatttggttagctatg

SEQ ID NO: 466506 - DNA, 1133 bp, Homo sapiens
agctcaatgcgtcttcctattactctgcatatcttatgtcttccatccaaaaagaatcaacttatcagataaataaccacctcatgaactaagatgaatcatgttccggcttttgtcctcctgctgctcttgcctaaggacaacagaagagacacgaaggaatgtgaccatccctatcattggcttgaacaactctggcaaaactgttcttgtggaggcattccaaaaatgagccatgttcagccatcagaaaccttgaaagaagaaaccatcagcccatagttgaaggactgcgctggctattagctgtcattgatacttgccaactaccacctacctcgagcatctcaatctccaagaataacacaggctctggagaaagatgctcatcacacagcttctccaccagaacaggaatgtcaaaggagaaaagacagcatctagaacaatgctcaatcgaagctaagcctctaaagtcaatcctacagagaaagtaaaagaaagtaacagagaaagtaaagagaaaaacagagggaaaccaaaagaaacagttgatatccctcccttagcaaacaggttcatctccagaactatcaggactacccggtttttaaatttccatttgataatatttctacactccccatacaactccacctactctaatatcacatccctgagaacccctgttgttcctgtatatctatattctagccatcaaatcaatcctatactcactgagaggctcaagaagagtgagatggcatccattgagaatgaagaccaccttggtaaaaaagaacagagactttacatctttgtaccgagatgctgctgacaaagcttgtggacaataagtcatgggtgatcaaccaaaactgagccttagaaatacagggttcatttagaaataagtatttttttctttaaggttcttaggcagaaaaggattggcaaaaataaatagaacttctttgctgagaattatgctctactgaatcattttcagtcatacctccataaacaactttgttttaaagccccagacactgtctgtgaagcccagaacaattgctttgctgtcccttcaggaacagcaactgctgcctctaccaacaatttggttagctatg

SEQ ID NO: 466507 - DNA, 1383 bp, Homo sapiens
agctcaatgcgtcttcctattactctgcatatcttatgtcttccatccaaaaagaatcaacttatcagataaataaccacctcatgaactaagatgaatcatgttccggcttttgtcctcctgctgctcttgcctaaggacaacagaagagacacgaaggaatgtgaccatccctatcattggcttgaacaactctggcaaaactgttcttgtggaggcattccaaaaattacttcccagtaagacagaccattgcatgaaatcggaactgactacacttttgttagatgagtatgaactttccatctatgacctgaatggagacctgaagggccgggaagcatggccaaactactatgcacaggcccatgggcttgttttcgtcctggattccagtgacataagacgcatgcaggaagtgaagatcatcttaacacatctgctgtccgataaaagagtggcagggaaacccatcttaatgagccatgttcagccatcagaaaccttgaaagaagaaaccatcagcccatagttgaaggactgcgctggctattagctgtcattgatacttgccaactaccacctacctcgagcatctcaatctccaagaataacacaggctctggagaaagatgctcatcacacagcttctccaccagaacaggaatgtcaaaggagaaaagacagcatctagaacaatgctcaatcgaagctaagcctctaaagtcaatcctacagagaaagtaaaagaaagtaacagagaaagtaaagagaaaaacagagggaaaccaaaagaaacagttgatatccctcccttagcaaacaggttcatctccagaactatcaggactacccggtttttaaatttccatttgataatatttctacactccccatacaactccacctactctaatatcacatccctgagaacccctgttgttcctgtatatctatattctagccatcaaatcaatcctatactcactgagaggctcaagaagagtgagatggcatccattgagaatgaagaccaccttggtaaaaaagaacagagactttacatctttgtaccgagatgctgctgacaaagcttgtggacaataagtcatgggtgatcaaccaaaactgagccttagaaatacagggttcatttagaaataagtatttttttctttaaggttcttaggcagaaaaggattggcaaaaataaatagaacttctttgctgagaattatgctctactgaatcattttcagtcatacctccataaacaactttgttttaaagccccagacactgtctgtgaagcccagaacaattgctttgctgtcccttcaggaacagcaactgctgcctctaccaacaatttggttagctatg

SEQ ID NO: 466508 - DNA, 2083 bp, Homo sapiens
attttctgggcggataggcaggccgttatgcatggagaccttgcctgtaacacccccagagaccttgctgtggtcccactggacactggccacttgacagctgcctcaaacgcagaagtccgggctagcccagaagtaccagatggcagtggtgccactggcagtaagggaggcacctgggcaacagccacacctcagctgttgtctgaagaggacctgccttggcactgtgacctgtaccaggacacttgcagaggggatttttggcaatcagagcctggcaagtgtgagggagggccctggggtagaagctcatggatcccacaggcagaagcaggcaatgaatgtgaagcacatgaagagtttgaagaaaaaggtagagcagaaggattgggggttgatatcaaccctcctgatcctgccctgaccactcttgtcctgaagaaggagaagcagcagacgcagaaaaggaagcacacaggcaagtggaagcatccggagcatgtcaaggacccagcctcaccacggcagtgcctgggacccggctgtgtgtatcccacctggccaggctccaagtactgttcagatgactgtggcatgaggctggcaggtgcccacatcaataacatccttccccagcacatccagcagtggcaaaggagcccctgcattgccaatgagcatggcaagaaaatgctcgagcacatccaccataagcaacagaacacctatacttgcctgaaggacatggagcaccatttccatgaacttgaggccatcattctgcatggcaaacagcaggctagcaacaaaggtgaaaagggcagcaaagacctgcagatcttttgcgcctcctgcaggcggcccatctctaagcgtgtcacctttcaccacatggagcactgctttgccaagtatgagtgccaattgcccgttgggtccctgtaccctacttgtattgaaagggccacatggctcttctgtgatgtctacaatctgaaaagtaagaggtactgtaagcgcctccaggtgctgtgtcctgagcactcttgggaccccaagtccctcaatggattagatgatgcctgcccacattggtccacatacagaaagagaggaattgtgcctcagaagctgtatgtaatggatgacacccaggagcctcatctgcacctggacctaatatggtgataaaattttaggcttggagctgatactgtaatgaggtcatgtttcctgaggctgtttttcctgaataatctacaaactcaagcaaagtaataattatattcaaacaaataaacttttctctaacatggagtcagtactgtgaaaaagtatccatttttaactgttgcaccttgggttcttatttcaaaaagttccatgaagaagatcagccccagcaaaacaaacaaacaaacaaacaaaaacagttggatccagagatgcctgagttagagatgactttggcaactctcctcattggcatacttaaaaccctgctcagggaggagcttatttgccaccttctatgcggaagcatgttcacgactgcacctgtgctgcctttactccacctctacatacaatgactcggctaaccagccccaccaaggcccttgttttcaccttcgttccaggaggtgctgctttgaggaattatccccagtgtcctccttgttgcaagtaataaaatcctcttgttaagtcctccttggttttggtcattggacagtcactgccaagcaatcaaacccactcgtatgagtaacaccttgttgagatgtagcacaaggattagttggataagatttgttgagatactcaatcacagaattgttctactttctgacaactcccaattagagctggtctccacttctttgaacccttcagcaaattgcccaaccaaagctcaagtcctataatatgtccttttaatatcctcttattgagatgctccatggttccccatgatgtgcactctctcctgctacaatgagtaataacccaacttactcaagtatagctatgttcttggtgatctttgactgggggcattgatatcttgtaactcttc

SEQ ID NO: 466509 - DNA, 2204 bp, Homo sapiens
aaatcaatttttcttctaatctaattgggtcttttcagggtttagtgaagtagaaaagttgtgtgtaaattaaatttttgttatcaaattttctttgaaatgctctagaagatcacgctaaataatcaccccaccttcattttagccttttataaatctaattgtatgatacattgggttgacttcaattcaaggcctgcttgcactgtttcttacagtccaaatctttgcctatcattccaggctcattttcaatatattagacagaaatcctagtctgccatggtggggaaagatggattaattagtatttaaagacaccctattatgtgccagatactgaacgcagcaattcatctacagtatctcatttgatatttgtgacatcactatgaggtggaaattattgttcactttctgcagaggaggaagtcaaggcccagatagatttggtaacttgtctaacttgtgccaccaggagtcagtggtagaacagggatttgaacccaggccatcttaatacaaaagaggcctttcctgggctcgagcagacagagggtgggggctggcgtcaagaaggaggcgtctggctgctgggtggagagtgcttctctggtcttttgttttggagggctctgggagccagggtgggcagaggagctttgggctgcccgaggcggactgtgcaagttcctagtcctgactggaaaagccagtgtcctctcttcttgtagtgcttggcaagtcccactgtaccccttgggaaagctcctctctcccaccccttccaggactggtaatgaaattattcccagagaccagagcactggaaaatgccccctcaaagactcctgcctcctctgtttgctgcagtagccatcctgaagggcaagcaagcagtgcccaagaaagaattgggaaccggtgctaggcgagcatcgtctaaccttgtgctctgcaaggccttgaggaaaaggcaatccaaattagaagccaaaggaacaggcctttggcagtcacttaacacaatcacgaagcaaagggaaatgatcaagtctgtcaccagggtcagtgccaatttgtttaagaacgtggtggtcggagatggctatacagaaaaagtgacatttcagatggattttgaacgatgtgtaggaattccttgcagggagaaggtccaaaccccaggccagacaatcttcctgggcttcctccagttccacagtagggccctggctcccagaaacctgccttgctggactgtccacttggagcaagaaggttgtgggagcagctggggagggaccaagggctttgactcccccactggaaacaccaatgtggctccttgtggatgtactgatgaacgactctccacagcacagccaactgtgctgcttgtggtggagaaaagggtgaagggatggggatggtactgcactgaccccaacaagcccctggatgaatacagatggcagacctgtggtgggtttccagagaccatctcagtccagcacagtaaggacactgatgcaggtccactgacaggagcacagaggacgaatgaagtaactctgctgggcatgagggtagaacgggagctcggggaagttgtcgtggtctgaatgtttgtgtctctccaaaattcatatgttgaaatcctgactcccaagatgatggtattaaggtggggcctctgggaggtgattaggttgtgagagtggagcccccattatgggattagagccccctagaagaagagacacgtgacggtacaacaagaagatggccacctgtgaaccaggaagcaggccttcaccaagaaccaggccatgatggcgccctgaccttgaacttccagcctccagaactgtgagaaataaatatttgtttaagccacccagtctatggtattctgtttaacctgaatgtcctaagatagaagtcttcacaaacaaggtgattcctggccaggggtttgaagggtcaatagttttcctagaaggacaaaatgaggagagtggtgcaggggaatgaaacaacacaagcaaagatgcaaaagtgacagtagctgggtggggagttgcaactatttcagcttatctgtttgacttttgcttctcagtgcctggcatggtggctggcacatatggtgctcagaagatgttgggcgaataaatggaccttcttgctcctgggggatc

SEQ ID NO: 466510 - DNA, 1526 bp, Homo sapiens
tttacaccagttggctttggatgaagagtagccctggaaagatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggtgaggatgatgtggtgggcagggcgtcaagggagaaacctcagcaagcatcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtaccgtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatacttttttttttttacattaaagaactaaaaaaggaaaaaaaaaa

SEQ ID NO: 466511 - DNA, 2754 bp, Homo sapiens
cggggtggcttagccgttgataacagaagattctgagatgggtgagaagtggtccacacgtggccactgtcattcctctggcataatggacttgggctcaggaggtcaagccctcttcaaggagcatgagctgaaattgctaaactttgggagttttccgtgacacccttcaaagtgctcacggtgtggcatggatcagctggggagggttgatgtggttttgccctgtggggtatctatctgtgtacttttgtctgagggaggcaactggggccacttaggccggcaggtgcccactgtgattggttgacatgataccaagcaacaggatcatccagtcaccttcaatgcagggaggatggctgacaggctccctggggtgacactttcatgcaatcagatgtcgagttggactgtgacatagagccatgtggccacactaaattcccccccacccttcccctgtccacaaccgtcattgtctgttcttgccatccagtggccactgcctccaccatggctgaggctttctctaagacaacctctgaggaagaccagagcatccaggagcccaaagaggccaactccatgacggcccagaagcagaagaagcgccatgccaacagcggcggagatatcttcggggacagctttgccgcctatttcccccgggtgctgaagcaggttcaccaggccctcagcctttcccaggaggccgtgagtgtcatggattctatggttcgtgacatactggaccgcatcgccaccgaggctggtcacctggcccactactccaagtgcgtgaccatcacctcccgggacattcggatggccgtgtgcctgctgctgccggggaagatgggcaagctcgctgagtctcagggcacgaatgccaccctcagtttcctaaatggccgtttttatcagttatctttctaggttatctttgtggtgatattatcaatgtactgatgtttacccttttcactctcattctcctacaactggatggtggaattttccagaacttcattatgtgcgatatggcaagagagaaagtgaatacgctgatataagaagcaagaaaccttccttccttccagatgtgtgtcagtagaattacagagtgtccacggaaacagctcatgccctagtgtacagtggtgcagccaatgagtgacctgaagtctatgagcaacactcattgtcccaatgtgggacgagtgaccgaagctgaacccacaacagccttcctgtgatattccacgtggtggttaaaggcatggcgatgtgattctttacctgatgtttttgtttgcagtgtttgtaatcatggtcttttagggatatgaatccaaagctaagattaatatacgttccttgaccctaacatcaagttatacagagcattgtcagccattagaagaagtcagataacgcttatttcctcaaaagattggcatattaatattcacgttaatattaatacaggctacctttcattgtgctctcttctgggtcccaagtcttggtatttttagaattttttttttctataagtgtattgctgaatttcagagcaggtgctgacttacccattgctttccttttccattgatttccagtcgcccgagtatgtggacaagagaacatactctgggattgcaacccacaggaatttattatgttgtgccttgaagctcaatatgtggccatttttgttaaatgtttcccgtaaattttgaaacatctcataaacaacccttctccttcatatgtagaaaccagtaaaggatggcactctcagtcaaaccacgaagcaaaagctggataaatgacaaaaatcaaaattttcttgagcccgtcagaagtgggaaagaaccaccccagagggacccaacacatagccacatagattatttcaccatttaaagaggaccccttggtcaagagggaaaagggttcggggcaggatagtagccagagcttccctgagtagtgcagatgggaagaggggaaggtcacctccagagctccacttgggatccatagagaaatgatatagaaccaagaagtccactcactgggatttgttactttctgtttttccagaatattagaaaaatattatgaaaatagttgaagagaaatgttatgaaaatagttgaagctgtacttactgcacaaggagaccaagaaaaactcccacaaaatcagctgcaagtaaatccctctggatggtgccgccacatgttcctacaagtccagaacaacccttgccaaaccaaagacacttggcagaaccctgttcctttctagagacagagctgtatacctgttccaaaacaccacatctcactcagtgacttatttctcattatgctaattgttttgctgtaaagtgccaatgtttctgtgaattaagacatacgaataaatttctgaagttacccttgcatatgtgtgtaattagacaagtccttttgagaaaccagatccattgggatattttaccctggaatatgtgttttccctttgtaaattcagaaatcaaagaggaggattagtaaaacagggttaacaatgaaatctgatttgtttgtggggagtgaagaatgaggtggcaaggggactgatgttggtgaattataggaagaaagaggaagggggtggattgatgcgaagatcggaagaggaagctcgcacatttgatatagcatttcagtgagtgattgagcagaagggaaacgtagc

SEQ ID NO: 466512 - DNA, 1121 bp, Homo sapiens
ctagaaggcttagcactgcaggctctgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaaaacttcattatgtgcgatatggcaagagagaaagtgaatacgctgatataagaagcaagaaaccttccttccttccagatgtgtgtcagtagaattacagagtgtccacggaaacagctcatgccctagtgtacagtggtgcagccaatgagtgacctgaagtctatgagcaacactcattgtcccaatgtgggacgagtgaccgaagctgaacccacaacagccttcctgtgatattccacgtggtggttaaagaatattagaaaaatattatgaaaatagttgaagagaaatgttatgaaaatagttgaagctgtacttactgcacaaggagaccaagaaaaactcccacaaaatcagctgcaagtaaatccctctggatggtgccgccacatgttcctacaagtccagaacaacccttgccaaaccaaagacacttggcagaaccctgttcctttctagagacagagctgtatacctgttccaaaacaccacatctcactcagtgacttatttctcattatgctaattgttttgctgtaaagtgccaatgtttctgtgaattaagacatacgaataaatttctgaagttacccttgcatatgtgtgtaattagacaagtccttttgagaaaccagatccattgggatattttaccctggaatatgtgttttccctttgtaaattcagaaatcaaagaggaggattagtaaaacagggttaacaatgaaatctgatttgtttgtggggagtgaagaatgaggtggcaaggggactgatgttggtgaattataggaagaaagaggaagggggtggattgatgcgaagatcggaagaggaagctcgcacatttgatatagcatttcagtgagtgattgagcagaagggaaacgtagc

SEQ ID NO: 466513 - DNA, 1953 bp, Homo sapiens
ctagaaggcttagcactgcaggctctgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaaaacttcattatgtgcgatatggcaagagagaaagtgaatacgctgatataagaagcaagaaaccttccttccttccagatgtgtgtcagtagaattacagagtgtccacggaaacagctcatgccctagtgtacagtggtgcagccaatgagtgacctgaagtctatgagcaacactcattgtcccaatgtgggacgagtgaccgaagctgaacccacaacagccttcctgtgatattccacgtggtggttaaaggcatggcgatgtgattctttacctgatgtttttgtttgcagtgtttgtaatcatggtcttttagggatatgaatccaaagctaagattaatatacgttccttgaccctaacatcaagttatacagagcattgtcagccattagaagaagtcagataacgcttatttcctcaaaagattggcatattaatattcacgttaatattaatacaggctacctttcattgtgctctcttctgggtcccaagtcttggtatttttagaattttttttttctataagtgtattgctgaatttcagagcaggtgctgacttacccattgctttccttttccattgatttccagtcgcccgagtatgtggacaagagaacatactctgggattgcaacccacaggaatttattatgttgtgccttgaagctcaatatgtggccatttttgttaaatgtttcccgtaaattttgaaacatctcataaacaacccttctccttcatatgtagaaaccagtaaaggatggcactctcagtcaaaccacgaagcaaaagctggataaatgacaaaaatcaaaattttcttgagcccgtcagaagtgggaaagaaccaccccagagggacccaacacatagccacatagattatttcaccatttaaagaggaccccttggtcaagagggaaaagggttcggggcaggatagtagccagagcttccctgagtagtgcagatgggaagaggggaaggtcacctccagagctccacttgggatccatagagaaatgatatagaaccaagaagtccactcactgggatttgttactttctgtttttccagaatattagaaaaatattatgaaaatagttgaagagaaatgttatgaaaatagttgaagctgtacttactgcacaaggagaccaagaaaaactcccacaaaatcagctgcaagtaaatccctctggatggtgccgccacatgttcctacaagtccagaacaacccttgccaaaccaaagacacttggcagaaccctgttcctttctagagacagagctgtatacctgttccaaaacaccacatctcactcagtgacttatttctcattatgctaattgttttgctgtaaagtgccaatgtttctgtgaattaagacatacgaataaatttctgaagttacccttgcatatgtgtgtaattagacaagtccttttgagaaaccagatccattgggatattttaccctggaatatgtgttttccctttgtaaattcagaaatcaaagaggaggattagtaaaacagggttaacaatgaaatctgatttgtttgtggggagtgaagaatgaggtggcaaggggactgatgttggtgaattataggaagaaagaggaagggggtggattgatgcgaagatcggaagaggaagctcgcacatttgatatagcatttcagtgagtgattgagcagaagggaaacgtagc

SEQ ID NO: 466514 - DNA, 1899 bp, Homo sapiens
ctagaaggcttagcactgcaggctctgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaaaacttcattatgtgcgatatggcaagagagaaagtgaatacgctgatataagaagcaagaaaccttccttccttccagatgtgtgtcagtagaattacagagtgtccacggaaacagctcatgccctagtgtacagtggtgcagccaatgagtgacctgaagtctatgagcaacactcattgtcccaatgtgggacgagtgaccgaagctgaacccacaacagccttcctgtgatattccacgtggtggttaaaggcatggcgatgtgattctttacctgatgtttttgtttgcagtgtttgtaatcatggtcttttagggatatgaatccaaagctaagattaatatacgttccttgaccctaacatcaagttatacagagcattgtcagccattagaagaagtcagataacgcttatttcctcgtgctctcttctgggtcccaagtcttggtatttttagaattttttttttctataagtgtattgctgaatttcagagcaggtgctgacttacccattgctttccttttccattgatttccagtcgcccgagtatgtggacaagagaacatactctgggattgcaacccacaggaatttattatgttgtgccttgaagctcaatatgtggccatttttgttaaatgtttcccgtaaattttgaaacatctcataaacaacccttctccttcatatgtagaaaccagtaaaggatggcactctcagtcaaaccacgaagcaaaagctggataaatgacaaaaatcaaaattttcttgagcccgtcagaagtgggaaagaaccaccccagagggacccaacacatagccacatagattatttcaccatttaaagaggaccccttggtcaagagggaaaagggttcggggcaggatagtagccagagcttccctgagtagtgcagatgggaagaggggaaggtcacctccagagctccacttgggatccatagagaaatgatatagaaccaagaagtccactcactgggatttgttactttctgtttttccagaatattagaaaaatattatgaaaatagttgaagagaaatgttatgaaaatagttgaagctgtacttactgcacaaggagaccaagaaaaactcccacaaaatcagctgcaagtaaatccctctggatggtgccgccacatgttcctacaagtccagaacaacccttgccaaaccaaagacacttggcagaaccctgttcctttctagagacagagctgtatacctgttccaaaacaccacatctcactcagtgacttatttctcattatgctaattgttttgctgtaaagtgccaatgtttctgtgaattaagacatacgaataaatttctgaagttacccttgcatatgtgtgtaattagacaagtccttttgagaaaccagatccattgggatattttaccctggaatatgtgttttccctttgtaaattcagaaatcaaagaggaggattagtaaaacagggttaacaatgaaatctgatttgtttgtggggagtgaagaatgaggtggcaaggggactgatgttggtgaattataggaagaaagaggaagggggtggattgatgcgaagatcggaagaggaagctcgcacatttgatatagcatttcagtgagtgattgagcagaagggaaacgtagc

SEQ ID NO: 466515 - DNA, 1922 bp, Homo sapiens
cggggtggcttagccgttgataacagaagattctgagatgggtgagaagtggtccacacgtggccactgtcattcctctggcataatggacttgggctcaggaggtcaagccctcttcaaggagcatgagctgaaattgctaaactttgggagttttccgtgacacccttcaaagtgctcacggtgtggcatggatcagctggggagggttgatgtggttttgccctgtggggtatctatctgtgtacttttgtctgagggaggcaactggggccacttaggccggcaggtgcccactgtgattggttgacatgataccaagcaacaggatcatccagtcaccttcaatgcagggaggatggctgacaggctccctggggtgacactttcatgcaatcagatgtcgagttggactgtgacatagagccatgtggccacactaaattcccccccacccttcccctgtccacaaccgtcattgtctgttcttgccatccagtggccactgcctccaccatggctgaggctttctctaagacaacctctgaggaagaccagagcatccaggagcccaaagaggccaactccatgacggcccagaagcagaagaagcgccatgccaacagcggcggagatatcttcggggacagctttgccgcctatttcccccgggtgctgaagcaggttcaccaggccctcagcctttcccaggaggccgtgagtgtcatggattctatggttcgtgacatactggaccgcatcgccaccgaggctggtcacctggcccactactccaagtgcgtgaccatcacctcccgggacattcggatggccgtgtgcctgctgctgccggggaagatgggcaagctcgctgagtctcagggcacgaatgccaccctcagtttcctaaatggccgtttttatcagttatctttctaggttatctttgtggtgatattatcaatgtactgatgtttacccttttcactctcattctcctacaactggatggtggaattttccagaacttcattatgtgcgatatggcaagagagaaagtgaatacgctgatataagaagcaagaaaccttccttccttccagatgtgtgtcagtagaattacagagtgtccacggaaacagctcatgccctagtgtacagtggtgcagccaatgagtgacctgaagtctatgagcaacactcattgtcccaatgtgggacgagtgaccgaagctgaacccacaacagccttcctgtgatattccacgtggtggttaaagaatattagaaaaatattatgaaaatagttgaagagaaatgttatgaaaatagttgaagctgtacttactgcacaaggagaccaagaaaaactcccacaaaatcagctgcaagtaaatccctctggatggtgccgccacatgttcctacaagtccagaacaacccttgccaaaccaaagacacttggcagaaccctgttcctttctagagacagagctgtatacctgttccaaaacaccacatctcactcagtgacttatttctcattatgctaattgttttgctgtaaagtgccaatgtttctgtgaattaagacatacgaataaatttctgaagttacccttgcatatgtgtgtaattagacaagtccttttgagaaaccagatccattgggatattttaccctggaatatgtgttttccctttgtaaattcagaaatcaaagaggaggattagtaaaacagggttaacaatgaaatctgatttgtttgtggggagtgaagaatgaggtggcaaggggactgatgttggtgaattataggaagaaagaggaagggggtggattgatgcgaagatcggaagaggaagctcgcacatttgatatagcatttcagtgagtgattgagcagaagggaaacgtagc

SEQ ID NO: 466516 - DNA, 768 bp, Homo sapiens
aggtgtgagtgacctccagctctgttgcagctgagagtatgatgaagttggtgataaaggaaggtagccttaagcagcatgaatagaagtggtatgtccccagtaggtggggacagcactgtcagcttctacattttgttgttcataccacccctggagcaccgggccaaggtgggtagagccgacacccccttgtctcggggctctgaggctcttgaaagcgcgggaaccagcgtgggggcgggatccccagtgcccccggtgcgtaggcgcactgccgcgctgccacgccctctcccggcccctggccagggcaacggtgccaggggactggcgaaggcgcgcggtgggcgctgcactgcccccctcagggcgggcgacgcgctccttcgcgggcccagcgcgttcacttcctgggcccggctggcactgccctgcgccgccgcccgtcagtcccggtaccccgccaggaaatgtcttcttcctgggaagacggccgctgtctgcggcagtgggtggcagagtctgaaaccaagtcgcacaagccctgggagacagaaagccttgtgtttgtcttggggactgttccgtcagaatgagcagcttaaaaaatgtcgcctgtgaggtctcagctcgtacaacaagaagatagcaatctgcaaaccagaaagtgggccctcacaagaactagatgatgatggtgtcctggcttcaaactcccagcttccagaactgtgagaaataaatttctgttgtttataagttacc

SEQ ID NO: 466517 - DNA, 1124 bp, Homo sapiens
atctggcatttccttgtgctcataatgagaatagttctccaattagccaagatgaacctcatggacatcaccaagatcttctccctcctgcagcccgacaaggaggaggaggacactgacacagaggagaagcaggctctcaatcaagcagtgtatgacaacgactcctatactttggaccagcttttgcgccaggagcgttacaaacgtttcatcaacagcaggagtggctggggtgttcctgggacacccttgcgcttggctgcttcttatggccacttgagctgtttgcaagtcctcttagcccatggtgctgatgttgacagcttggatgtcaaggcacagacgccacttttcactgctgtcagtcatggccatctggactgtgtacgtgtgcttttggaagctggtgcctctcctggtggtagcatctacaacaactgttctcccgtgctcacagctgcccgtgatggtgctgttgctatcctgcaggagctcctagaccatggtgcagaggccaacgtcaaagctaaactaccagtctgggcatcaaacatagcttcatgttctggccccctctatttggccgcagtctacgggcacctggactgtttccgcctgcttttgctccacggggcagaccctgactacaactgcactgaccagggcctattggctcgtgtcccaagaccccgcaccctccttgaaatctgcctccatcataattgtgagccagagtatatccagctgttaatcgattttggtgctaatatctaccttccatctctctcccttgacctgacctcacaagatgataaaggcattgcattgctgctacaggcccgagccactccacggtcacttctatcacaggtccgtttagtcgtccgcagagccttgtgccaggctggccagccacaagccatcaaccagctggatattcctcccatgttgattagctacctaaaacaccaactgtaatcttgcagtctccccaggaacttatgatgcctccgaaaaccacctggggactcacgtagctggagagcattacagcctcatccacttacctggagctgctctcctgtattatcctccacaataaaattctccagaaaataagt

SEQ ID NO: 466518 - DNA, 2669 bp, Homo sapiens
gtgtacacacgtgcgcacatacgtatgtgcagcaagtttcgatcttcaaaaacccgcagctactcacagtgtaagatgcctgtcggggtggggctctgggcctggaaaaactagagcagtctggatgctgcgaggcggcgagcagcaaacatcgttcaagatgtcccaccaagaaggcagcacagacggcttaccagacttagggactgaaagcctgttcagcagcccagaggagcagtctggagccgtggcggcgacagaggcctcctcagacattgacatagcgacctcagagctgagtgtgacagtgaccggagatggcagtgatagcagggatggtggattccccaacgatgccagcacagaaaatcgaagctcagaccaagaaagcgcaagtgaagacatcgaacttgagagcttggaggactttgagcatttcctcatgagtggtgaaagtttattccattaccctttagtgggagaggaggagacagaaagggaggaggaagacgaagagatacaagaggagggaggggaggaggaggaagaggaggaggaggaggaggaggaggaggaggaggaggaggaggaggaagaagaacagcctcgggcgggtccacaaggcagtggcggcaaccatgagcagtattcgttagaggaggatcaggcgctggaggagtgggtttcctcagagacatctgccctgccccgacctcgctggcaggtcgttactgctcttcaccagcggcagctgggttcacgtccccgctttgtatatgaggcctgtggggcaagagcctttgtgcagcgtttccgcctgcaatatcgtcttgcagaccatgtcggctgtgtcaatactgtacactttaaccagcgtggcacccggctggccagtagcggtgatgacctaaaggtgatagtgtgggactgggtgcggcagaggccagtactgaactttgaaagtggtcacacaaataatgtcttccaggccaagttccttcctaactgtggtgattccactctggccatgtgtgcccgtgatgggcaggtacgggtagcagagttaattaatgcatcatatttcaacaatactaagtgtgtggcccagcacaggggacctgcccacaagttggctctggagcctgactctccttataagttcctcacttcaggtgaagatgctgttgtcttcaccattgacctcagacaagaccggccagcttcaaaagttgtggtaacaagagaaaatgataagaaagtgggactgtatacaattactgtgaatcccgccaatacctaccaatttgcagtgggtggacaagatcagtttgtaaggatttatgaccagaggaaaattgataagaaagaaaacaatggcgtgctcaagaaattcactcctcatcatctggttaattgtgatttcccaacaaacatcacctgcgttgtgtacagccacgatggcacagagctgctagccagctacaatgatgacgatatttacctcttcaactcctctcacagtgatggtgctcaatacagtaagagatttaagggacacagaaataataccacagtcaaaggtgttaatttctatggccccaggagtgagtttgtagtgagcggtagtgattgcgggcacatcttcttctgggagaaatcatcctgccaaatcatccagttcctaaaggggagcagagaaggtacaataaactgtcttgaaccccacccttacctacctgtgttggcgtgcagtggcctagatcatgatgtcaagatctggacacccacagctaaagctgccactgagcttactgggttaaagaaggtgattaagaagaacaagtgggaacgagatgaagacagcttgcaccatggcagcctgtttgaccagtacatgctttggttcctcctgcgtcacgtgacgcagagaggtcgtcaccaggactggagaagtggtgaagctgaatttccagatgaagaatcggatgagtcttccagcacttcagagacatctgaggaggaggtccaagaccgagtgcagtgcatgccatcctgaaggcctcatatccagtccagctacatgccacctaagtacactggactttaaaattcagtttgactaatttagaattgtcaatagattaatagatttgctttttgtcttctattttccataatatatgctgaaaaccgtctcttccattccttcctctctactttcctttctttcttccacacattctttctctcattcctttcctcttggtttctttacgcctcttttgttaccccttattcttacatgagtgcatacacaacttatttatgcctcttttcctttgttcccttatagttgacctctaaattttctgaattttgctgaaagaattaatacccttattagatgcatctactcaaatctgacagtctgaaaacggttacctttttactttttttcatctttaacaattttttctgaagatcgagttcctcagttgacctgaaaatttcagaaatgtgtttcttctttagaaaataagacaaactacagttttgttctgtcgatactgacacttggccgcacacacacagtctcagaaaaggaaaagagaagtagtgtgtagattaattcttaacacttggccatacgcagacacagtctcagaaaa

SEQ ID NO: 466519 - DNA, 959 bp, Homo sapiens
gagttggaatgtgacgtagagccatgcgaccataccaaagtgccccccacttccctggtccccaaccgtcactctctgttcttgctatctaatggccgctgcttccgccatggctgaggcttcctctgagacaacctcggaggaaggccagagcatccaggagcccaaagaggccaactccacgaaggcccagaagcagaagaggcgagggtgccgaggctcccgcaggcgccacgccaaccgccgtggggacagcttcggggacagcttcaccccctatttcccccgggtgctgaagcaggttcaccagggcctcagcctttcccaggaggccgtgagtgtcatggattctatgatccatgacatattggaccgcatcgccaccgaggctggtcagctggcccattacaccaagcgcgtgaccatcacctcccgggacatccagatggccgtgcgactgctgctgccggggaagatgggcaagctcgccgaggcccagggcacgaatgccgccctcagaacttcattatgtgcgatatggcaacagagaaagtgaatatgctgatacaagaagcaagattattagaaaaatattacagaaatagctgaagagaaatgttatgaaaatagttgaagttgtgcttattgcacgaggagaccaagaaaaaccccacaaaatcagctgcaagtaaatccttctggatggtgccaccaaatgttcctacaagtccggaacaacccttgccaaaccaaagacccttgccagaaccctgcttcttcccagagacagagctgtgtacctgacaaaacaccacatctcactcagtgacttatttctcattatgctaattgttttgctgtaaaatgccaatgtttctgtgaattaagacatacgaataaatttctgaagttacccttgcatatgtgtgtaattagacaagtccttttgagaaaccaaa

SEQ ID NO: 466520 - DNA, 1066 bp, Homo sapiens
ccgccgcgccccgagcccgccgcttccggtctcagcgcctgccgcagcagctgcggcccagcgagcggcccagatgcaggccatcaagggtgtggtggtgggagacggagctgtaggtaaaacttgcctactgatcagttacacaaccaacgcatttcctggagaagatatccctactgcctttgacaattattctgccaatgttatggtagatggaaaactggtgaatctgggcttatggaatacagctggacaagaagattatgacagattacgccccctatcctatccgcaagcagatgtgttcttaatttgcttttcgcttgtgagtcctgcatcatttgaaaatgtccttgcaaagtggtatcctgaggtgcagcaccactgtcccaacactcccattatcctagtgggaactaaacttgatcttagggatgataaagacaggatccagaaactgaaggagaagaagctaactcccatcacctatccgcagggtctagccatggctaaggagatgggtgctgtaaaatacctggagtgcttggccctcacaaggcgaggcctcaagacagtgtttgacgaagcgatccgagctgtcctctgcccacctcccgtgaagaagaggaagagaaaatgcctgcagttgtaaatgtctgagcccctagttcttggtcctgtcccttggaacctttgttcgctttgctcaaaaaacggtggagcctttgcactcaatgccaactttttgttacagattaatttttccataaatccattttgaatcaatcagtatcttttaggttttgtttgttctaaatgtaagagttcagactcacattctattaaaatttagccctaaaatggaaaaaaaaaattactaatcagaggaaaaccagaactttaatttatttcaaaaaggcctgaagaggccggtctggctagtggtctatctattttgttaatcttcaaaaaatcagctcctggattcattgattttttgaaaggtttttcatctctttatatccttcagttctgctctgatcttagttatttcttgtcttctgct

SEQ ID NO: 466521 - DNA, 1664 bp, Homo sapiens
ccgccgcgccccgagcccgccgcttccggtctcagcgcctgccgcagcagctgcggcccagcgagcggcccagatgcaggccatcaagggtgtggtggtgggagacggagctgtaggtaaaacttgcctactgatcagttacacaaccaacgcatttcctggagaagatatccctactgcctttgacaattattctgccaatgttatggtagatggaaaactggtgaatctgggcttatggaatacagctggacaagaagattatgacagattacgccccctatcctatccgcaagcagatgtgttcttaatttgcttttcgcttgtgagtcctgcatcatttgaaaatgtccttgcaaagtggtatcctgaggtgcagcaccactgtcccaacactcccattatcctagtgggaactaaacttgatcttagggatgataaagacaggatccagaaactgaaggagaagaagctaactcccatcacctatccgcagggtctagccatggctaaggagatgggtgctgtaaaatacctggagtgcttggccctcacaaggcgaggcctcaagacagtgtttgacgaagcgatccgagctgtcctctgcccacctcccgtgaagaagaggaagagaaaatgcctgcagttgtaaatgtctgagcccctagttcttggtcctgtcccttggaacctttgttcgctttgctcaaaaaacggtggagcctttgcactcaatgccaactttttgttacagattaatttttccataaatccattttgaatcaatcagtatcttttaggttttgtttgttctaaatgtaagagttcagactcacattctattaaaatttagccctaaaatgacaagccttcttaaagccttatttttcaaaagcgccccacccggcacacccacagctaaacagaattcttcattagaggaaatagcagttctgtttagctgtgggtgtgccgggtggggtgtgtgtgatcaaaggacaaagacagtatttgacaaaatacgaagtggagatttacactacatgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggttatttgtcgattagtagaagtgctttccatgttactttattcagagctaataagtgcttaccttagtttctagatacctagagtgtaacaatcatgtgttgcagctttactagtcttcaaacatacttcagcacaatccttaaccatatttgaccccttcttaacattcactgtcttgccaaattaccgacactgttcattcgaccatactgaccctcctttcctggcccacgaggacaaaagcacctcagtaatcgcttcgccaagatgtcccaggcgtcggtaagtcggaacgccagtgaacgcctcggacactaccacggggcatacgggtgga

SEQ ID NO: 466522 - DNA, 1336 bp, Homo sapiens
gccatctgggcgtatacgtgcaagtcacaggggatgcgatggcttggcttgggctcagaggcctgacaatttctatctgtggagtaacgcagttccccctccatgatgtggcccctggaagacaccaatctgcctactggctctatgggcttgcctcctctgaaaagttcctctggattggacagggaactaaaggaagatgtccatccatagaatgtagacaaggcactgataaatgtgataaacacagcaaggagccatttgcaatgtctggagacattctgagttattatcattggagagtggatgtggccagcatctggtgggtggagcccaggaatgctgctcgacaccctatgagtgcagaggatggccacaccacagagaatcctccagcctcaagtgtcaacagcacccacattgagaatcttgaactaaagaatacaaagattccacatatgagatcatgcaaaagttactagaaaaataaaattataagtcaacaaatatttgtttgaagtcttcaaaagctgtttaaaccatccagaaaaatatgaattctcatataaaccttatgaaaaataaaaatgattcctacccttaggaaaaaaatatatatatatatgtatatatatatatgtatatatatgtatatatatgtatatatgtatatatatatgtatatatgtatatatgtatatatatgtatatatgtatatatgtatataatgtatatatgtatatatatgtatatatgtatatatatgtatatatgtatatatatgtatatatgtatatatgtatatgtatatatatgtgtatatatatgtgtatatatatgtgtatatatgtatatatatgtgtatatatgtatatatatgtatatatgtatatatgtatatatatgtgtatatgtgtatatatgtatatatatgtgtatatatgtatatatgtgtatatatgtatatatatgtagcttcatgctttaaaagaagaaagatcaaaatagtatattaagtagtctcagaatacttcttgtacatataaaaaatactcagtgagttattataaaataaatcaaaaacagacagactgaatcttccttagattatatatgcttttaacttctaggagaatgaaggatgcaagctagaagattaatgaaagaaaatcaattacccccaaacaaaaatgtttaaaaatctcaattatagttcagattggccctttctagcaaaagtcaaaatgtggtatgcaaacacataatgtaatgccttcattcttcacacaagccttgactatgtacatggttagtgctcattgtttgaaaatccaa

SEQ ID NO: 466523 - DNA, 1464 bp, Homo sapiens
ttcagtaaccgctacaccgctgccaacatttggcatcgtttctctccatagagggcggggctccctgtgaagctggggagctgttaagtgggctggagtgcagtggcacgatcttggctcactgcaaactccgccttccaggttcatgccattctcctgcttcagcctcccaagtagctaggactacaggtgcccgccaccacacccggctaattttttgtatttttagtagagatggggtttcaccatgttagccaggatggtctcgatctcctgacctcgtgatctgcctgcctcggcctcccaaagtgctgggattacaggctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaccggagtgataccttttatttgtacaacccttttgtgcttttaaaaa

SEQ ID NO: 466524 - DNA, 1249 bp, Homo sapiens
ccggaactgcgcctgcgcttttcggagtattgtgaggattgagatgactggagtgtgtgtggcctggagagttgctcaataaatatatgttgccttccactgtgaagagctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaccggagtgataccttttatttgtacaacccttttgtgcttttaaaaa

SEQ ID NO: 466525 - DNA, 1252 bp, Homo sapiens
aattttccagaacttcactgtatgccatacagcaacagagaaagtgaatacgctgatacaagaagcaagaatattagaaaaatgtcatgaaaatagttgaagagaaatgctcactgcacaaggagaccaagaaaaaccccccacgaaatcagccacaactaaatcgctctggacggtgccgccaggtgaccctacatgtccggagcaacactttgaaaaccaaagacgcttggcagaaccctgttcctttccagagacagagctgtgtaccttgtctaaaacaccgcatctcactcagtgacttatttctcattatgctaattgttttcgctttaaagcgccagtctttctgtcaaatgggacatacaaataaatttctaaaattatccttgcatgtctactgggaaatacattcatttcatcacaacatccccaaagacttaacgccctccaacgtcaattctctaatatctcacctgataatctatatctggaatgggtgagcctccagggatctttccttgacttgtaaatggtccactcttgcgcatgccacttcacattttcttccctggatgcatgtctctgtgtctgaatttccccttttggcagaggcaggcctgcttgagagaaagctgtaggcaataaagacataggactcagtgggtcctcgagctcaggagtctaccaaagttaaagcacctttgtgttttgtctctcctggagggtgctaagctccttctgatggactacagaaaggcgttgatttttgaggactatccaacgttagtcgcatggtttctctgacagtgaagtcccttaaaagtttgtacatgctactgaatggtggggtttacaagttattataaaagtgcaaatgaaacacttaacaaaattacccaaatctaggactttaaagcaaatagtcatacatttctgaggattgaaatcacagagtatcttctctcccttttgagctggagaaggacaaatatatatatatatatattgtatatgcatatatatatattgtatatgcatatatataatatatacaataaaattactcaaaattcaagtggacttttaaaaacatgcgtagggatcaccttatttcccttcatcagtcaccattgttctcttaacatactggaggaggctggagatatccacatctacaactcaggattcctttgttctatttgttcagttgtgccccccgctgcctctgccacaccaaatacgtgaatcc

SEQ ID NO: 466526 - DNA, 1354 bp, Homo sapiens
tcctgccagaagtcaaggtgatggccctgaatgtgaattgaaagaaacatcgtctaccccagaaaaaaaggaagctccatagagtctggacctgccagtcactgtatcagtcccagtaagatgcaggtaatactggcaggcttcagcaaaggtacagtctagttacttccactgattcctcaggggaaaggcccttcagagaagagtagcctcataggatccttgaacagtgttctcaaagaaacctacagaagcaacttccataaagtcaaggtgatatcttcctgctggaggatcacaccttctttccttgaggtcacttcatcacctgccatctgtctcacactactacttacctctgagcagagtcataatgcctcggggtcagaaaagtaagccccgtgcccgtgagaaacgccgccaggctcgagaagagcccaaggacgtggaaggtgctcaagtcactgtagcagaggaaggagagtccctcacttcatctcctcatttcaaagatagtcctgagaggtcatctgctgtcgaaacacccagcaatgagcaagagcctgggatagctctagccatcaccactgctgcagctgtttcatgcacagcatctaatgaaggcatcgacagccaagttgaggaaaggtcaaatgcctcacaggcccaggctaccactgggcagagagcttctgatcacctggagttggtctttggccttgacgtgagagaagtggatcccaacaagagcatctatgtccttgtcaacaaactagaattaggccatgacacaagagtgaatcctaacagaagtttgcccaagaatggcctgctgatgaccatcctgagtgcgatcttcagccaggggaattgtgcccctgaggaggaagtctggaaggtgctaaatatgatgggggtatacgagggacaggagcacgtcatctatggagagcccaggaacctcctcaccaaagatttagtgcaagagcagtacctggagtattgggaagtgcccaacagcagtcctccaagctatgaattcctgtggcgtccacgagcctatgctgaaaccagcaagatgaaagtcctagagtttttggccaagatccatggtacagtccccagtgccttcccatcccattatgaagaggctttgaaagatgtggaagagagatcccaagccagaattgcagccagggcccgtactgccaccatggccagtgcacgttccaaggccacgtccagcagccttgcctgctccaagtgaaggctgaggaaaatgctttactgtgtttttgaagaggacagtcagtgtttcactagtggagggttggctgtgtctcgttataacata

SEQ ID NO: 466527 - DNA, 917 bp, Homo sapiens
gcaagttttcctgcttccatgatgttggaaggaagctggtgcatgtgtgaggaacgttgtgaaagaagcacaatggaccccccaaaaacggaagtgaaaaggaccatgcggtcagtcccctgtggattccagcacgacacatcaaaccataccatggtgtggctaggacccaacctgatagcagagatgaaggaaccaaccctaccggacccgcagccctggacgatgcagcttccacggacgacacaagccccggatgttacctgggggatgccgaagaggacaactcaggaggctgaacaaattctgcttcagacacagacaccatttactccaggatgcaaagccagaataagagcaatgaccaccacgcctgacaaacctgctgctgcatacatctgtgctctccaatcaataagacctgatgcagaaaacagaaaaggggaagagttagggattcagtcaggatggtgggaaattttgtaaaataaaccttcttggagggccagaaggtttttgcaaaagcttcaggatagagttaatggctgaaggcagcctaatcctctttgagctataacaagggtaactaacataggaatgtagaggagtctatctaaatagcttgtttgctcatgtggtcctaagactgacttttgaccatccacgggtgcatgattgctctctattcaggggttggcaatggtaattaccttctagtggtgtttattgagacttttgtcatttaatgtgggctgaataaatgctggaaaggccagcaagttggagccacggttgcaactctttacaacactctcctgggagtctgtaagcggcccagaccctcagccagactgacaagcataatatctgtgtcagtgtacattattcatccatcgttgggttagggtctgtgggac

SEQ ID NO: 466528 - DNA, 1182 bp, Homo sapiens
tgcgcactgggccgaccaatcagcgaggagcgcgggcagccggggcggctgctgctctcgtgagaacagaggacccaggccctcggaggagcttcgcggtgccagcctctgcaggtcctctgagggagcaacatcagggctccctcaggttcagaggtcgcctctagcttcccaggccagtcagccacggagcccgtgggcaggaagggcagcaggatggctgccaaggaccagttggaggttcaagttatggccgcccaggaaatggagcttgcaggaaaggatccagtaagtcatgagcatgaggaaagaaaacctgttacagagacaaaggagggagatgtaactgatgagcatggggaaagaggatcttttgctgaaacagatgaacacacgggggttgataccaaggagctagaagatattgcagctgacattaaagagcatcttgctgcaaagagaaaaaggattgaaaagattgcaaaagcttgcagcgaaataaagaacagaattaaaaatgttttgagaacaacacaactaaaaaggcagaaacgtgattatagaatttctctgaagttgccgaatgtccttgaagagttcatcacagatgagcagaaagatgaggaaggagatggagaaaaggaagaacaaattaaaatatttcaagagcaacaaaagaggtggcaacaagatgggaaaggaactgaaagagattgagccaccacacgagcaattcacaaaggtctgttctatttggtaacacaatacgttcttataaaatacaacacatgcataaaaatagaagacaatctgcttgtttctgaatgtatggaaagacattttggttatacattttaaattacttaccattttcactttgaatgtgttgttccagatttaacataagtagtaaataacataaaataacataaaacagtatttttaggattcatgaatagttttgtaggagttatttagaacaggaaaaggttttccaagtttaagaaaaaaagaaaaacaagttcattcagattctgtttttctgcctgcaatcacttatgcaggaataagtgagtccttatggggagcatttaattcctaaagtttgcattttcataaaggattttccttttacccaaagcatgtgttggtgtataagtctaactactacttcaagtttct

SEQ ID NO: 466529 - DNA, 1232 bp, Homo sapiens
tatggttgcatcaggggaaggatttattgatccacaccattttcttggattttctatcctccccagggggcagaggtgggttgattgtgtggcgtgtcggcaaaggccaggctgggtcttaagtattcatccaccttcctcctgatgctccacgcagatgtgctgggacctacttcagagtgtccctgagccatgactgcttgactccacagatggcttcaggaagacagcacagaagagggacctgtgaaagttgatagaatctagaattacctgaaggagaagcatcaagtagccccagaagcctctctgcatttctcctccctaacacacatgctgattttcaaaggaggcaaatcctatttgaagctaaagtcacataaagagatttggaatgaggaaacaaattatagcagcctgcaagttgtagaatgaagaaatgcaaatgtaaagtactgaactttgtcatggatggatttaccaaagagaattactctgcataacatgaataatggagttcagaaggaagcccatatcccagacttcctcggttgtgctgttttactgaggttgggtggagtcaacacatcatggataaagaagtccctaaaggcagtcccagggagcccgcactgaacatcaagaagtcagacaaatccttcaaacgcaagaagcccaccgaaaatgtgctgatctttttaatcaacagacaactgggcaggcacagaagtgacatcgacctgtcaagatgggtgtggatgctgtcataaagcaactctagggtggacatggccttggacaaaaagtcatgtggcttacatgctgaagcctgcccatatttttgagaaattaaatataattagaacaataaactcctcccatcatcgccaaaaaagagccaccagcctctcctcagaggacgcagctggctgtaggatggagaggagggggcaagaaggagccaaacccacaggagcagaggccaataacagccaacctcctacactccatggccacacaacagaagagacagaatttaggatacagagttatgtgtggataaatctcaccatcatactgagtgagaaaacaagtagcacagaattatgtaccaaagagaaacccaactgtgccaagcagtacttgggtatatacatagacagtaaagttatccaaactagagcagcagcacattcaagtggaactctgtccactttccgacttgactagtg

SEQ ID NO: 466530 - DNA, 2157 bp, Homo sapiens
ccagcagaatgcattggaattgatgatggatcaccttcagaagcagccaaacacattacgccacgttgtcattcctgatctccaatcttcggaggcagtgcccaagaaacaacagaaacaacacgctgggcaagtgaagcggcctctcccacatcccaaggacgtcaagtgtttctgtggtttatctttatccaactctctcaaaaacactggggagcttcaggagccttgtgttgccttcaaccagcagcaactggtgcagcaagaacaacacctgaaggagcagcagcggcagctgcgggagcagctgcaacagctgagagagcaaaggaaggtgcagaagcagaagaagatgcaggagaagaagaagctgcaggagcagaaaatgcaggagaagaagaagctgcaggagcagaggcggcaaaagaagaagaagctacaggagcggaagaagtggcaggggcagatgctacagaaagagccagaggaggagcagcagaagcagcagctgcaagagcagccactgaagcataatgtcatcgtggggaatgagagggtgcagatatgcctgcaaaacccacgtgacgtatctgtgcccctctgcaatcaccctgttagatttttacaggcccaacccattgttcctgtccagagagcagctgaacaacagccctctggcttctatcaagatgaaaactgtgggcaacaggaagatgagagtcaaagtttttatcctgaggcgtatcaagggccccccgtgaaccagctgccattgatagatacctcaaactctgaggcaatttcttcttccagcattcctcagtttcccataacttcagactcaaccataagcaccctggagaccccacaggattacatccggctttggcaagagttgtctgattcactcggtcctgttgtccaagtgaacacttggtcttgcgatgagcagggcaccctgcacggccaacccacctaccatcaggtgcaagtttctgaggtaggagtcgagggacctcctgatccacaggctttccaaggccctgctgcataccagccagaccagatgagatctgcggagcagaccagattgatgcctgcagagcaacgtgactcaaataagccgtgctaacagtactttcatgaccagtgatgaggggaaatggggggagggggcaggccaatgaggtctgcatggccaggggaccttcaaggtgcgtaaagtcccttggggtagggtttagtgggtagagacttatttgtttcctgataggttatgtttgtaattgtttgttaagcacagcctgtttcttggaagttatgctgtagaggcagcctgtgatccgtagtatgctagggtgtgacagcagccagccacagctggatctgatgtcttgtctgccccgcccagctttgcatatccatgttctaccacaggaaggtggcctgccaagagtctgctcaaagttttcaacataaagaataaagaaaaaaaaatgccaaagtgcttttcaatctagtaaatctagagggttgttttgtcttagccacaagaattccgaggtcttgaccctgatgatcaacctgcctcccctccatagtcttgttggagaagcccagagagaatgggactccaactaagggaacctgaaatcaactcaatggaggcacttcagagctaaaataattatggcttccttgcttaataaacattttcgttcactgcaactttgtgaattgatgagtgacgtttggaacctgactgtgccaaggtccctggtgaagggttggttccctacagttaggccccttttgtagaccctgctcccctcagtctcttgttcacacctcagctccatgccacatttgcagaggccagcgactgctgccttcccacatggccgtgtgcccaggcccgctgtgtagctttttttcgtgtagctcaggcatgctggctccttcattgacaccaagggcagccacaggcccactgaactctgaaacagttggcctaggggctaccttctcagggtggatggtgtttgtgcctcacatattacttcagaagtaagcctgaacactaaagggcagtgtacccataccttttacatgtgggttctttctctcccatcagtagactttttaatagataggagt

SEQ ID NO: 466531 - DNA, 2989 bp, Homo sapiens
cgggatagaaagaaagggggagggcaccacatatagtcacagtctaaataacacaaattgaaggtctgatgtttgggccagacctacactgtacaccaggagtgctgactccagcacagatcaagtcaatttgtcaggcaattctggactctgggaagcagtatgccataaagaagaggaaaccattccccctgatgtattcttactatggaaccgaatacttggctcacggcttgtcgtctattcttcagatgcttctttcttaccatgagcatctcaagccctcagatcgggaattggtatggcagagcgtggactttctcatggaacaggaacaaaactgcaactggccacctgagctcggcgagaccatcgagagagagaatgagctggtgcactggtgccatggcgctccaggaattgcctatctgtttgccaaagcttatctggtttccaagaaaccgcagtacctggacacatgtattcggtgtggggaactcacatggcagaaaggcctgctaaagaaggggcctgggatttgccatggagtagccggcagtgcctatgtcttcctgctgctgtaccggctcacgggaaactctaaatacatctaccgagctcaaaggtttgctcaattcttatttaccgaggaattcaaggccggttctcgggtccttgaaagtatatacagcttgtatgaaggcttctctgggacagtgtgctttctgattgacctgctgcagcccaatcaggctgaattcccactcttcagctccctgtaggaaaaagtttacccctctgtgtgcgagtgtgtgtgtgtgtgtgtgactttgctatttcaatattaaagatgtcttttgaatactgtagcagcagtagaatccctatgttcttgaaaatgcaaaatgtaacatgagttgcacatagactctctagcagtagaaatggaatattctaagtgcagaagtttggttttagaatctgttaaggaaggacggcccaatctttgaaaaggtacagctttctcaactttgaacatctgggggaactcttcttggaagtctgaattttaatatctttaatccaatggctctaaattaacaaacattaaaaaatggatttcgtagaatcaaattattagggggagcactttgcaaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtacaaagaaatactctgtcaatatagtataactgcttatttcaaattgtatctaggaatgaataactactattatttaaagtactactgaattttgaggaactgatcaaagaattagtattattaataaaattgtactatttgcaatatatttgccttggcacaaatgcagagttaaaaacataaaattataaaaaaaaataatagtgattggttgttactactttaaaatcctactaatttccattagcactaaatcaaacagcacttatctgttgtatacaagtaaaattttgaaagactcggacacaaaatgaaaggctttttaaaaatgtctttgccataacaggttatatgacctcttgctaattgttatatttccttaggggcactttgaggctctttcaaagacatctgcagcaattaggtctaaatttagagtagaatattttgccagatattttactatatcacaaaatgtcatactactgtattttataataaaaccaaattctcaagtattctggtatgttacatattaatataccaaaacatcactttctataagtctattattatgtacataatatttttaaaaataatgggtattttggtcctagtgaaaaagtataatgcaatacatgacattaatctttagtcaaaacccattgaggtgtctgacagggaaattagcaatcataagctataagatatatattattttcaaggacaaaatggcaaatgataatacagaaagacgtgatcactggagcaagttagctggtgtgcagactaagaaggatcaacttgcaaatgctcatcagaatttagcttttgttattggttgttctgcaggggatagtactagtcagttgatattgcttccctttcatgtgggagtttgctcacagcccactgcatggtataatgaaatctctataagcaagatagagtcagaagcttagagatgcactttatggtttttacaactgctgttacaatgttctaaacactgtgatctttccaaatgtgttttctgtattcgttttgtactgtagaaaataattcgctataaactggactttatagtgtttaaagcgatgttatttattggcttattgcccctccttataatacatttatgtacagtacacttaatgtaaaacctgtgataatcctttgccttaaaataaaatctaatgctaaatattcagtgtcctgattaataattctaagctaccaatttttcctttaaagctaaccatgatgtcaagtaaaacattacacaaatactctgtggagtgttgctgctgattctgtatttgtggcagtgtatgtatcttggcccaggacatggtggccttctgggttctataaatagacattagtaatccttttagggaaagggcctgctacctctcagctgctggctgaatctgccccttaactcataaatggattttctcatgccacataaaaaacagaaaaacagcccaccacattctctccctgtacctcttttttggtttgattccttttgaatctttatattctatttgtgtttacattattttcctaaatagaaaaatgccagagatgcctgaagattgaaat

SEQ ID NO: 466532 - DNA, 5679 bp, Homo sapiens
  misc_feature (3)..(3): n is a, c, g, or t
  misc_feature (6)..(6): n is a, c, g, or t
  misc_feature (8)..(10): n is a, c, g, or t
acnctngnnngtttcttccatctgcacccagttgtcttcagcatgggggagcagaaccactctcccgggaaggagcttcagcacaggacgcgagcagaggctccaggaaagaaaagctggcattcccaggcctatgcccttggggccgtttccaactttatgtctacttttctgacctttcctatctataaggttgtgttccggcaacagatccatgccatggcagtgtcagaggctgtgagacagctttggcatgaaggtcctcaatacttctaccggggaatctaccctcctcttctctccaagacgttgcaagggactcttctgtttgggacttatgatagcctgctgtgctttctctctcctgttgggccacacaccctgggacaccgctgggctgccgggctcatgtctggcgtggtggaggccgtggcactcagcccctttgaaagggtgcaaaatgtgctccaggatggtcgcaagcaagctcgcttccccagcaccttcagcattctcaaggaattcaattcttatgggctttgggggcggctgtcactgggctactatcgtggtttctggcctgtcctggccaggaacagcctggggagtgctctatatttttctttcaaggaccccatccaggatggcctggcagagcaaggcctgccccactgggttcctgccttggtgtctggtagtgtcaatggaacaatcacctgcctagttctgtatcctctgattgtgctggttgctaatatgcagtcccatattggatggcagaacatgccaagcctgtgggcctctgcccaggatgtatggaacactcggggccgaaagctgctcctgatctaccgtggaggctccctagtcatcctaaggtccagtgtgacatggggcctcactacggcaatccatgacttcctgcagaggaagtcgcactccaggaaagagctgaagactgactagctgcagaaagtgtggcatggcagctttgttattctaaatcttccctggttggttctatatagcttacttctttggctaggttgcctaatacagccatcctttagcatctataaactcattgcatgggagaagttcccaactaccaacctgttgagcaaggacaaagcccaaaagtattccttagtcaaaaagaaacgttcaccccagtctctccacagtttcagtagcctcagagccaggaggcctttaaataacatgtaacccagattaagtgtcattcctttaaggaattccttggcaataaacagaaacttaaaaagatgaccttacttaggcactctgagctctgggacccctctaggtgtcctccagaccaaactgagtggaactccaatttcaaagaactatgcttgactcttaggatgggaattccataaaacttctcagatggctacattttcatgatattgttcactgcctctaccaccacctctcacttctcaaggctgtgggtcctactttcagggtagcagctgtggctggaaatcctaaattaggcttgcatgaactcgtcaggtgccacaagaactagtggggctggagatgggagtgagaagagcgtggcccatggatggaaagaataaaaactttgaaagaaaagatttaattacatgcaaaatagaaacatttgctatagtctgcttggtgttatctgctaggacatttctgagagcaaggtgataacattgcctagaaaccgtttgagtttccctaagaaacctggaagtgaagtgaccatatctcttcacagaaaattgcatattttgttgatgtggttaaatgtagttactatgacataaagatcagaaatcttagcctgtcattcagagccattcaaaatatggtcatcatataactttcaacatattgtcactccacttacataaaccccaaacactagccataatgaactattgttctctccccagacattccatgaactttcccatggccatactctggcccacactattctttccacctgcagtgctccttcttcacatgccagtctaccaaaatccttccagttccttgaagcccagctcagagcacttcatacagggtactgattccattatgtcactaatctcatgtgaccctttgttcttgtattcttcaatacctcctactagactgtaaaactcattgaaagcagggatttttgtatgcattttaaaatcttccattgtgcctaggtgctcaataacgttggtcaaattactgagttgattatcaagctgtgatatggtatatcctcagggtgctgtcccttgtacatgacgataaagttattgactcactgtcagcaagacacgtgcctttgggctgtgtttttgctttcttttaataattgatttagttttgtgctaatgataatgatgctgctactgataataataataacaataataaaaattactttcaactggcacatttgatgagtttatattactgatggcatgtttgctattagcaccagttcaggaactgaaatttcacaaacagaatcacactgtacaactgtaccatttgtttcaactctggaattttgaggatttccaagatgacatgtgttatagtttccccctacagatatcttagtaatgccctcctcttgcatctccttactgaaccaaatttgtcctgtatttgtcttacttggttgtagatttagcagtgagaacttctcactgaatgccacagaaattaaagacatggttgttggaggtatgatgtcagagagcatttgccaccaaggttggcagaaaatggctggtccaggagagctgaagatgagcttccacatctgcagatcgggatgtgttgggacagtactcaacttgtggattcaaggaagtatgaacacagagtctgcataaggaaaggaaaaagatgcattcatctcccaagtacactggtgatttccacttatgtcattctgtccatccatgtccctttcttcattttaacttcttatttaaaaataatttcaaacatttaaaaatgttgcaagcataaataaagcttaaagaacacccatgtcccctttaccctaattcccctattattaatgtttctccccatttgctttattatttaagtgtgcactctgtctatacacacacaggatattttttccctgaactatctgagagttgcatacatcagttttcaatattcctagattcaatgtttgtagatccaaattattttttaagagaccgtgttttatctctgacaatgggacagttattacagaatataataaaatgaaaactcacacaatatatgtgatattgtgaaatatatacttggtctttgatcctgtttcttggcatacaactcctaaaatccttagaatttccaaagtgatatctttttgtatgctaataattgactgatggctggcagcctctggttgcttcaggatgggaactagtcaccaggaagaccaaggcaccattagagggttgggacttaacagcctcattcccgacctccagggaggggagagggatggaaggttaagttgatcaccagtggccaatgatttaatcaatcatgcctacgcaatgaagcttccataaaaaccccaaagcactgggtttggagagcttccagatagctgaacatgtggaggttcctggagggtggtgacccagggagggcacagaagctctgagccccttccgcagtacctcaccctatgcatctcttcatctctatcctttgatatatcctttataataaagtggtaaacgttaagtatttccccaagttctgtgaccctttctggcaaattaaacccaaagaaggggtcatgtgaactcaaacttgaagcccatctgtcagaagttctggaggcttggatttgcgactggtgtctgaagggcctgggaacagtcttgtgaaacctagtcctcagcttgtgggatatgacgctatctccaggtagattgtgtcagaatggaattggagtacacccagctggtgttcgctgcagaactgattgctcacttagtgtgtgggaaaactccacacatctggacatggaaatattctgtgctgattgccgtggtgtaagagcaatgcaaaaagtttgggtattttcccctcggagtatattttaaagctaaattgctaataattgcttaaatttactatatttgcctttataaaaactttatgtatgttgaagcttgaagctatgcaattataatataaacatggatttacaactaaagcatgttataatttaaataattgagtttttcaaatcggttcatatgaaatcctaggcaatattgtaaaattatacagacctgtcaactttttccacttaaaagttgtgagcaaaatttaagggcatagtcgttttcaagtaattttaaatgtcaatgttaatatttagtttagtgatgttaatggagctatgttttctgatattaaaaatgagttttaggagttgagaccaataaaataaggaggtaataaatatctatatctgtttaaacacataaaatatacaatttaacactaaaattacttggtataaaaagtcaaaaaaaagaataaaaagccatcatacaacacaatatatgcgtgatatatatttttctctaaatataaactacatcagcttttataaagctcaagttgaaataataacgttttatgacaaatcattatatggtatattctgacttaattttgcatttacaatttatttttaaacactaaatagcattataattttactgggataactatatatagtgtagtatattaaagttaataaaatgacgttgcatatgagagaaaaagcataataaatcagaaacaatataaaaagctttcagaaaagataaaaatattgtatttctctagtctgttcactctccagtgtctctggttctttcatatcatcttcctttcctcaaatcttttaatactccctccctcatcatttccaactagtgaccctactttctatttcattaagaaaacagatacattcagaagagaactgccagtttaaagaacatttacaaagccatcacccatgtaataaccagccagagcaagaaatagagccctttaataacctactcttctccccccaccactgatgacaccgctccctccatcttaggtgtagcccccatgctgacttttgtaataataatttctttgcttttgtttataagttttcttccttataagcatctctaaacaacagttttgttttacagatgttcaaacattaaatgctttttagacttggaattgtgactatcttgtttcactccacattgcttgtgagactcattgatattgcagatagctgtagttgatccatttttattgttgtacagtttaccattgtataaatataccatgatttattcatgataactttgaggaacattctggttgtttgcaggttttatttttacagttcattagttttattgatgtataataattgtatatgtttatggggtatatgtgatattttgatacatgtgtacaatgtgtaatgattaaatcaaggtaattgggatatccatcagctcaaacatttatcatttctttgcattgggaacattccaaatcttctcttctagctattttgaaatacacaataaattg

SEQ ID NO: 466533 - DNA, 1354 bp, Homo sapiens
cagacttttatgctctgcttccccttgaatgctttggcatttagaaattttttccaccagtacccgaaattatctctcccaatttccaacaagttcttcatcttcatctgggaccaccttggcctggacttcattgtccatatcactatcagcattttggtcaaagccattcaacaagtctctaggaagttcttacccttcccacatcttcctgtcttctgagcccttcaattttctagaaagttccaaactttcccatattttcctgtcttcttctgggccctccaaactgttccaacctctgcctgttacccagttccaaatttgcttttacattttcaggtatccttatagcagcaccccactctctgtggtaccaatttactgcaatgtgaatactgtattgaagtggaaagaaattaactgcatggaaaaccatttgggcattgtcatagtccaggtgagaagtagtgagggcctggactatatatttctatgatctagtgtattgcattgccttttactgatctcacctgaaccacagaattgacacttaactccaaactgttgttatgttttcttcctgataattgtttggaaatcatggaatgtatttcttatcctttagtgttcctccatataggacaacatccacagtttgaatattaaagttgtaaatcctgcttccataactgatcactgagttccaagtcttgcttaaaaatctcagtcagaacactaacctatttgatgtagtccttaccaagcctagcttatatttaaaactctcttcaccaacatcctccgccattacctatcaaataaactttcttaaaagacacacctgctagccccgacatattatttaagggtacttttgattcttttttataacgttaaagataagaaactgtttggaaaaataaacactaattattcaaatgaatctaacttttaatcttaaaggagctctgatttgaggtgacaatgattttgaaccttaaattctttggaaagactcagaatgaagtccattgtggaggctcagaaaaacaatttcctgggaaatgaagcagtatttttatagagagaactgtatacatgtgaaagcttattcatcgttggtcaggcaagagaccctccaatgactaaataaacctgaatttaagtcagaggaaagaaattacacagatctctatttactgggtggccttcaaatatatcatgtcctcataaacaagatcaagggagggaacactatcccagaagaggttctgtctgtaatcttctcagtttgaaaaatactaaataaagaggtattccactgttctatacttctctttggtgacattgt

SEQ ID NO: 466534 - DNA, 417 bp, Homo sapiens
attcctttcgtaaccgcaccacacccgaggagctctgatttgaggtgacaatgattttgaaccttaaattctttggaaagactcagaatgaagtccattgtggaggctcagaaaaacaatttcctgggaaatgaagcagtatttttatagagagaactgtatacatgtgaaagcttattcatcgttggtcaggcaagagaccctccaatgactaaataaacctgaatttaagtcagaggaaagaaattacacagatctctatttactgggtggccttcaaatatatcatgtcctcataaacaagatcaagggagggaacactatcccagaagaggttctgtctgtaatcttctcagtttgaaaaatactaaataaagaggtattccactgttctatacttctctttggtgacattgt

SEQ ID NO: 466535 - DNA, 683 bp, Homo sapiens
agcgcttgaagcatggagtctcttcgcgggtacacccacagtgatattggctaccgcagcctggcagtcggcgaggacatcgaggaagtgaatgatgagaaacttaccgtgacctcgctgatggcaaggggaggagaggacgaggagaatacacggtccaaacctgagtacggaacagaagcggaaaacaacgttggcacggaagggtccgtcccctcggacgaccaagaccgtgagggtggcggcggccacgagccggagcaacagcaggaggagccgcccctgaccaagccggagcaacagcaggaggagccgcccctgctcgagctgaagcaagagcaggaggagccgccccagacgaccgtggaggggccacagccggcggaggggccacaaaccgctgagggaccacagcccccagagaggaaacgccgccgccgcaccgcgttcacgcagtttcagctgcaggagctagagaactttttcgatgaatctcaatatcccgacgttgtggcgcggcagttatgactaattttgcaggtcatgggatcaaaaggtgactgtttgaaattacagaagaccatagctgcatcaaggaagtatttgcaaaaaaataaataaataaaagttagaatgggcttattagctttgcctcagggtgtgtgtgtgagtgtagtgatgga

SEQ ID NO: 466536 - DNA, 977 bp, Homo sapiens
gtggttgccagggattcctttctggaactaccttctctttacattttcctggaaacatgacctacatgaccttggtgatatcattgctgcttcccatgtatattaagaggccactgtgtggacataatgttactggccactacaccttggttgtggagaagaaccttgaggtctgtgctgaggaaaacgaaactcttgtctttgaagtgggcttggtgctgaactccataagcggaacacaaggcgcttcatggggtcagaaaaggcgggttcgcgcgccccctgctggccaccagagacagtgcgagattctcagcgctcactgtgtagcggaccatcgtgataggtataagaaccactgcaacggggtcttgcagtcggggagagagattgggctcaactccaaatacagcatgggccagtgggactttacagccaaggaccaggatggaggtcagaggatggaaaattgctaagaggaaatcaggagttaaagaccggcttaaaatgctgaatatttcatataaaacaaacctaaaatgattctgaaaggtggagagaaaaaagcagaccagctaaaagcctcagaacttaagtattgagtcacctgagacttttgcatttctgatgaccagatgacttcactcatgactgaactggtcctgtgttccccacccagaagcagactcagtcacaaaggaccattttccacactcctataattgcatccccaactaatcagcagcacccattgcctagccccctgcctgccaaactatttttttaaaaaccctagcctccaaattttgggagaggcagatttgagtagtaataaaactctggtcttccatttaggtggctctacatgctttaaagtatttcttttttgtaattcctctgtcttgatattaatctatctgggcagcaggcaagacgaacctgtcaggtggttacaaatttgggggctcatctgggat

SEQ ID NO: 466537 - DNA, 1528 bp, Homo sapiens
ggctaccgagagggcagccatgaacacccaaaagggttccctcaccataaacgtccacagaggttccctcgccatgagcatccaaaggggttccctcgtcccccgggatatggatagctcgggtagagacatgcagctgcgggtgatcccggctgaggtgaagttcctggacacgatggccgggagggtgtaccgcctcccgattactgtgcataatatttgccgctggaaccagaaaatccgatttaaggagcccgtcaagccacagttcaaactgatgttgaccagtctggataaagaacttgcttctggccttcagatgacagctatggtggaatatcatcctgataaagacgaagacacttttgaccggctacttatttcaatagaaaataaaacaacagaaattcctctaattgggttgattccatcctgtcaattggaaattgaatcagtagttaattttggcacactggttgccaatagtaaagtatattctaaagagattactatcactaaccatggcaaagctccaggcatatttaaggcagaataccacggccaattacccatcctcatttttccaactagtggtatcgtggatgctaagtcatcaatggttattaaagtagatttctgtgcagaccagccaagaattgtagatgaagaggcaatagtgattttgcaaggtcaacctgagatgctcttgagtatcaaagctcatgtggttgagcagattattgaattattaagcatgagtagtgacagaaggctggaatgcatacactttggtcctgttttcttcggatcatcaaaaattaaacatgcacgtgtatacaataatagcccagagcccataaattgggtggccatcatacaagatgatgccgtgggagaagaattgaaagtggaattagcactgacaggcacaggacttcctgttttactacagtttgatccaggaccagttcttaattttaaaccttgtttcatgggtgaacgttcagaaattcagtgcatcataaaaaatcaatgcgaattacttcctgtgacgtaccactttaaaaaaactgcaaattttgaaattgatcctgaaaagggcaagattactggagggggtatggtggatgtgatgtgttcatttgttccacatcaacttggagtcttcaaagtgaagcagatgatagagattattggtttagtggcagaagaagatttgcaatctttgtcggtaaaatctttccatcacgtatatttagctttcaacagcatctgtaaagcttccaccaagaaagttgtgatgaaatttgatcctggtttgttctctggcccctcaagattaggaacatccgtgctggagggactgaagtgttcctggtctgctggccacaacattcctattgggggtgctgtcaaaagcacctcatcggggccagggtggtgggatgcacttgtactagcagtggtggtgtagtggggtgcacatggacactaatgccagcaggggaggagaggggagatctgcctg

SEQ ID NO: 466538 - DNA, 758 bp, Homo sapiens
  misc_feature (19)..(19): n is a, c, g, or t
tacggctaggtacgaggcngggtgttgcaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagctgggaaacctggtgttctgggccttcgctgggttaacaatcactgctattggggtta

SEQ ID NO: 466539 - DNA, 350 bp, Homo sapiens
agtcgagctcgctaccggttacgattctttgcccagtcaaatagctctggtcaaactataggttgggagaaatactgaaattatttggctaaaataagaatgggtttcctgtgaatttacctagccccataataatggaattgactggttatttgaaattaagttagtagctggctcagaagtaaaggtgggtatttttagatatggtgatttaattttaattttacatttaattacagaaaaatctaagctgttgtctgatataagtgctcgtctatggtttacatacagaaggaaattttcaccaattggtaggtaaatcatttgttttactgtgctttattccttgt

SEQ ID NO: 466540 - DNA, 2392 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtataccctacttggttgacagccatatttagaattattcatgtggtgaattacacattttatctgtgcatcatatacaattccaaa

SEQ ID NO: 466541 - DNA, 2181 bp, Homo sapiens
cggggagcggctttgagtggaaccgtgtgaaagagccgggttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtata

SEQ ID NO: 466542 - DNA, 2701 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcaggactttctatgtagaccatcttgtcatctgcagagagggacagtgatatttcttcctttccactctgtgttttatgttgaatagcagtgttttatccaagtatgaagatcagattactattttcactgactacctagaagaatatccagatacagatgagctggtatggatcttagggaagcagcatctccttaaaacagattgggaaagaaagaccttttaacctgaaactgctaacagcccagcacccagataaagccagagcttggaaagaggcagctctgagatttgtgtctttctgaggagacatcctcttcagaggccctcacttagcgtggaggaaggaacaggaagaggctgatgaaaaggcaggagaggaagttaggcattgtggagctcctcctgagcctggcttcattattttgattggagaattctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtata

SEQ ID NO: 466543 - DNA, 2391 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagattgggaaagaaagaccttttaacctgaaactgctaacagcccagcacccagataaagccagagcttggaaagaggcagctctgagatttgtgtctttctgaggagacatcctcttcagaggccctcacttagcgtggaggaaggaacaggaagaggctgatgaaaaggcaggagaggaagttaggcattgtggagctcctcctgagcctggcttcattattttgattggagaattctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatgcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtata

SEQ ID NO: 466544 - DNA, 800 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaagtaagtaaaagagtctggcatctgccttattctgctgtctcctatgcttccctccctagacaactaaacctcccatcaaccgaggtattcttgcaatcccgctaagctactcctcccactaaaccatcaaatatctgccattttgctcagatggctctttgaaatgtgtaagca

SEQ ID NO: 466545 - DNA, 522 bp, Homo sapiens
ggctcacccttgtccaggcgtgtgattcctgcactgaggagtgagagcaacctaaagatacagtccctgtctcaaaggccctggcagacttgagaaatgagattcttccaataagcccagaatccctattgggagctaaacaagtacccagtggccagaatgaagagcatgagccctagaggaatggcctgggctttgtgcaggcggggagtcagctgagccctggtggcagaggagagggccttctaggcagggtggggggcatgtgaggttccccttagttttgatattggaatatcttctagggctgaagactccttacttatccaatattctgttcttccatttctagaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtc

SEQ ID NO: 466546 - DNA, 1013 bp, Homo sapiens
  misc_feature (19)..(19): n is a, c, g, or t
tacggctaggtacgaggcngggtgttgcaggatgacagctggagaatggagtcagttttatccaagtatgaagatcagattactattttcactgactacctagaagaatatccagatacagatgagctggtatggatcttagggaagcagcatctccttaaaacaggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggtaaagctatatgtttttcttag

SEQ ID NO: 466547 - DNA, 2084 bp, Homo sapiens
cagtttccaatttttggctactatgactagtgctgctaagaagattattttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtataccctacttggttgacagccatatttagaattattcatgtggtgaattacacattttatctgtgcatcatatacaattccaaa

SEQ ID NO: 466548 - DNA, 2310 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtata

SEQ ID NO: 466549 - DNA, 2010 bp, Homo sapiens
  misc_feature (19)..(19): n is a, c, g, or t
tacggctaggtacgaggcngggtgttgcaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtata

SEQ ID NO: 466550 - DNA, 2612 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagattgggaaagaaagaccttttaacctgaaactgctaacagcccagcacccagataaagccagagcttggaaagaggcagctctgagatttgtgtctttctgaggagacatcctcttcagaggccctcacttagcgtggaggaaggaacaggaagaggctgatgaaaaggcaggagaggaagttaggcattgtggagctcctcctgagcctggcttcattattttgattggagaattctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtata

SEQ ID NO: 466551 - DNA, 1636 bp, Homo sapiens
gatccttgtattgagtggcactgtgaaggtataaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtata

SEQ ID NO: 466552 - DNA, 881 bp, Homo sapiens
aataatccccaatgttagaggtagggcctggtgggaggtgtttgggtcatgggggcggatccttcatggcttcatgctgtccttgctataagccaagacacattctcttcttgttgagagtgttggttgctgaaggttggaagctgagtcccttccaagaatttgcccttggtaaacaggaacttgccaaagttacactcactcgctcaaggacagtcaaattcaaggtttggtccatgggtgtgggatatgaaagtctggccccccgtctcaatttgggctgctacatcagaatcactcctcacaatgggaaaatattaaaaatcccttggaatgtgaatcccttggaggtggggatgacagcctcaaatggcatggctgattcacaaattatggtcactaattggctgagatagtaaaggacatttgaagactgagaagaacttggtgagactgagtgccatatgtaggaagaactgaaagaagaccttggactatggggcaacagagaaaggagagggaggaacttggagctctgaaggaaccgttatccaatcattgcagttgccatagctcagctcacatcctacataaatcccctgacagcagcaaaaactcagtgcaaagagccggcttattttgaacaacgctcagaaccagacggagaaaggaggagacagaaatcatcatttatcattcgggacaaaaggcacagtcagtgggaaaatctgattttcaatcatttaaagggtattaaagtgaaaaagagatagacctggcaagatgtgtctgaggaggatttttttttaaatgaaaacagcacatggtgggcttagttactgtatggatttaaatctgatgcgatgttaaatctatatgcc

SEQ ID NO: 466553 - DNA, 392 bp, Homo sapiens
cctggcatgatctgatcgcctttgaagcagtcgcagctgttttccagacgccttgctcctcaggtcggggagtgatctgatggcccaggttcgagaaacttctttgccctccggctctggggtccgctggatctccggaggtgggggaggagcctctcctgaggaggcggttgagaaggcggggaaaatggaggaggcggcggcgggggctacgaaggcgtcttcgagacgtgaagccgaggagatgaagctggagccattacaagagcgtgagcccgcgccggaggagaacttgacgtggagcagcagcggcggcgacgagaaggtgctcccttcaatcccccttcgctgtcacagcagctcctcgcccgtttgcccgcgccgcaagcccc

SEQ ID NO: 466554 - DNA, 2345 bp, Homo sapiens
cctggcatgatctgatcgcctttgaagcagtcgcagctgttttccagacgccttgctcctcaggtcggggagtgatctgatggcccaggttcgagaaacttctttgccctccggctctggggtccgctggatctccggaggtgggggaggagcctctcctgaggaggcggttgagaaggcggggaaaatggaggaggcggcggcgggggctacgaaggcgtcttcgagacgtgaagccgaggagatgaagctggagccattacaagagcgtgagcccgcgccggaggagaacttgacgtggagcagcagcggcggcgacgagaagtttatgacatcagggtttgaagacaagcaatcaacctgtgagacaaaggaacaggagccaaaattggtgaaacccaagaaaaagagaagaaaaaagtcagtctatactgtaggcctgagagggctaatcaatcttgggaacacttgttttatgaattgtattgtccaggcacttacccatattcctctactgaaagatttcttcctctctgacaagcacaaatgtataatgacaagccccagcttgtgtctggtctgtgaaatgtcttcgctttttcatgctatgtactctgggagccgaactcctcacattccctataagttactgcatctgatatggatccatgcagaacatttagcagggtacaggcagcaggatgcccatgagttccttattgcaatattagacgtgctacatagacacagcaaagatgatagtggtgggcaggaggccaataaccccaactgctgtaactgcatcatagaccaaatctttacaggtggcctgcaatcagatgtcacatgtcaagcctgccatagtgtttctaccaccatagacccatgctgggacatcagtttggacttgcctggctcttgtgccacattcgattcccagaacccagagagggctgacagcacagtgagcagggatgaccacataccaggaatcccctcacttacagactgtctacagtggtttacaaggccagagcacctaggaagcagtgccaaaatcaaatgcaatagttgccaaagctaccaggagtctactaaacagctcacaatgaaaaaattacccattgtggcttgttttcatctcaagcggtttgagcatgtaggcaaacagaggcgaaagattaatacctttatctcctttcccttggagctggacatgactccgtttttggcctctactaaagagagcagaatgaaagaaggccagccaccaacagattgtgtgcccaatgagaataagtattccttgtttgcagtgattaatcaccatggaactttggaaagtggccactataccagcttcatccggcaacaaaaggaccagtggttcagctgtgatgatgccatcatcaccaaggctaccattgaggacttactctacagtgaagggtatttactgttctatcacaaacagggtctagagaaagactagtcttaccagaccacttactgaaaaaaaagtaaatgattaggcaaggattttgaagtgacacacagacctacttggaatggacaatgacagtaacacctatgtgacagctagtatcttgatataaagaacctattttagcatggcccatgggtctgtcggaagaaaaaaatgaatactaaccagtgaccattcaaccttaagaaatggggagagggagaagaggttgaaaatggtcacataaagcataatgaaatgaaaagaatgctttaggtggggacaacgggagtagaagtgttctgatgctactctatgtcatttgtttttacagaaatatcttgtgaagtcagggagtattcctttatcagcaaaaacttcacaattggtgttccagctgtggctgaccagctaaatagtttgaaagaaaaataatattttaaaataaagtttaaagagctttaaaagaaaaacatttaaaaaggaaaaaatcatttttaagattttaaaagaaaaaaacttttaaatgttgaaaaaaatttaagttgttatttttaaaagaaatattttaaaagttaaaaataattttttaatttaaagaagtttcagaattttaaaaattaaaagcaaagaaaattaaattcttaaagtttaaaaatgtaaaataaattaaggaacaaggttaaaaatgaaagtttaccaaaaaaaggaagaaaatactgttaaaaattaaagttagaaacaaaggaacatcttaaaagtttcaaatgaaggaaaataatataaatagatatttcaaaattaaagcataaaatatacgtatttaaaaagtgttaacaaaattactactataatgatt

SEQ ID NO: 466555 - DNA, 1768 bp, Homo sapiens
cgggtgggtccagagccaaaaacagcacagttcctggatgccctccagcaacgctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggttgatatgcatgacatgctcttggaagaactggcaccagtgggaacggcacacataccaccaaccatgcacctagagtcacctgcactccaggtaatgggacctgcccaggaggccccagtagcagaggcatggatcccacaggcagggccaccggagctgaactatggtgctactggagaatgtcagaactttctggaccctggatatccattaccaaaacttgacatgaacttctcattggagaatagagaagagccatgggtgaaggaattacaggattctaaagaaatgaaacaattacttgattccaagataggttttgagatcgggatagaaaatgaagaagatacttcaaaacagaaaaaaatggagactatgtatccatttattgtaactttagaggggaatgctctccagggtcccattttgcaaaaagactatgtacagttagaaaatcaatgggaaacccccccagaggatttacagacagatttagcaaaactggtagatcagcagaaccccactctgggagagacacctgagaactccaacttggaagaacctctcaaccctaaaccccacaagaaaaagagtccaggagagaaacctcaccgatgtcctcagtgtggaaaatgttttgctcggaagtcacaacttactgggcatcagagaattcattcaggagaagaacctcacaaatgccctgaatgtgggaaaagattccttcgtagttcagacctttatagacaccaacgacttcatacaggggagagaccctatgaatgcactgtatgtaaaaagcgattcactcggcggtcacatcttatagggcaccagagaacccattctgaagaagaaacatataaatgtcttgagtgtgggaaaagtttttgtcatggatcaagtcttaaaagacatctgaaaactcatacaggtgaaaaacctcatagatgtcataattgtgggaaaagttttagtcgactgacagctcttactttgcaccagagaacgcatactgaagagagaccttttaaatgtaattattgtgggaaaagttttagacagagaccaagcctcgttattcatttaagaatccacacaggggagaagccatacaaatgtgtcccatgtggcaagaaaggagacagtgaattttgtcaaacaataaaaatgtgtcaggaacacaaggatgaaggggatgtcatttgcctgaagtggatccttcagctccagcagttgcaaccccgaaacatttgagt

SEQ ID NO: 466556 - DNA, 888 bp, Homo sapiens
cgggtgggtccagagccaaaaacagcacagttcctggatgccctccagcaacgctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttctgctgaactcagcaaatgagtcagtgcttttaactctatcagactcaattccccttctataacaaatagtttataatgtccactttactatgcacaaatgaaattgatagacaacataatctacccacatacatcaacccaaagcatcagtaaattgctccatggcctgaaggccaattctagccataccctgtttatctgtatactctgtatgtaatggtttttttatcttgttgaaaggtcattg

SEQ ID NO: 466557 - DNA, 4707 bp, Homo sapiens
cctgacaattgcgtttctaaggaaaccagactacaaaggaggatgatgcggtgctcatctctcaagaaacacatcagctttcatctttatcagtatgacactgacatgataggaaatgctgggctggtgattcagcagccatccattttacagtcagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacacttgataagatatttttaccccttcaagtccaatgtttgcgggcttggcagcctctcctttatattaacagaatcttggaa

SEQ ID NO: 466558 - DNA, 2161 bp, Homo sapiens
cctgacaattgcgtttctaaggaaaccagactacaaaggaggatgatgcggtgctcatctctcaagaaacacatcagctttcatctttatcagtatgacactgacatgataggaaatgctgggctggtgattcagcagccatccattttacagtcagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccagttgtctgagtcagggatcctcagatc

SEQ ID NO: 466559 - DNA, 4666 bp, Homo sapiens
cctgacaattgcgtttctaaggaaaccagactacaaaggaggatgatgcggtgctcatctctcaagaaacacatcagctttcatctttatcagtatgacactgacatgataggaaatgctgggctggtgattcagcagccatccattttacagtcagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacactatttgtaattatgcatgtaataaagcacagccttatcc

SEQ ID NO: 466560 - DNA, 445 bp, Homo sapiens
ctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattggtaaggatttcagaaaggggatagtggaatccactgtggaactcaataaatatgcctgaaatgggggaagacagggaaggggggactggttaggagccagaaggatagagctagcacgtccatcttcaatttgttttttccttctgtttgaatagaaaatgctcgaaagaaacaggatgggg

SEQ ID NO: 466561 - DNA, 3012 bp, Homo sapiens
tggcacaattttaatcaattgttctgcaaaaagttttcttctcttccttgctgatgcagagggccaaaatgttaccttcttcaaaccagatccttacagtctttggcgatgtggccgcttctcccacagttgtagcagatgtttccgagaaggacacagttcttagcattacgaccggactcaccacagcagtaacaggtgtctcagtgatgtcatacaaggtttgcacacggccccattcacgtgtcacggacattcctgacgcccttcccgcccgactttcctcctactcaagaagccaaaagcacaataatctgttaactgagaggagaggagtaagaggcccaagagggctgcagactggcagggaaagtgaagaattgaagggtagaccactaacgatagcagaggaaataaaggtagatgcagcgcatgcgctggaagcacactgcggcgattctggagaggttgtccttttctggcatcagcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggagtcagcatgaataccagcacagcccaactatgtgtaagcagatctgtgcaggaatgagagtcccagggagagaatccacgttgtttctgaaagaaaatggctatagctcactgttgtttactggaaatagtagggggaaggaaagatggaagtccaggtccagtgtcatatactgccctgcaccttactcacttctctgcctttagggtgatgccacactcaatcagaaactatgctactgctgaagaggtatattgagccctgcctggttaacctccagtgaggttattagagaattgggagaggctcaaatcagcatcctgcacctggttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacgcagttgtgttcatccattattgtcgatggcagctttcatgctacagcagagttgagtagttgggagagaaaccatatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacttcccctctctggcttttttgcatatttctgcagatgtcttgacctttctggggagagacatattgcttatctccaaaattttcttctgcttgcagagctgcctgttttagcagcagtgagggtttgacttagcagcaacataacatccctccatatgaggtcaaatacaaacagcttgtcgagtgttcacaaatatcactggaatttaaattggaatggccctgaatttgtagattaattttgggagagctgtcatttttacaatcttcccatacattaatgtaatatttttctccttttattcgggtcttcggtatctgcgtatgtatattctacttattacttttaatctcccccattttctggaaaaaaaagatgtctttggaagtgcaattctggtgggaaaagtgtagatgtcatctgcatagactagagccaatcagtagggaatgtcattcaaaatgtgttttgtgtttgatcttaccatttctttcaaatgttcctagcagcctgcattatttataatgttctgtattcctggtttagccatcctagtaggtgtaaagtggtatctcattgtgattttattttgcatttccctaaatgattaatgatattgagcatcttttcatgtgcttcttggccactagtatatcttctttgaagaaatgtctattcaagtctttggcagtttctaaatgagttattgtctttttgttgttaggttgtaagagttataatctggataacagatccttattagatatgtaatttgcacatattttctcccattttgtgggttgtcttttgtcttttttattttttattgcttgtgttttggtatcattattgataattcattgttaaattaaaggtcatgaagagttactcttactttttcttctataatttttagttttagctcttgtattcatgtctgtaatcaattgaagttaatttttaatatagtatgtgtt

SEQ ID NO: 466562 - DNA, 1273 bp, Homo sapiens
ctaggagttggtaccagcgtttgggaggtagaggtggcgctcatgcatatttgagacaacatctggatggttggggagaacggtgatgccacactcaatcagaaactatgctactgctgaagaggtatattgagccctgcctggttaacctccagtgaggttattagagaattgggagaggctcaaatcagcatcctgcacctggttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacgcagttgtgttcatccattattgtcgatggcagctttcatgctacagcagagttgagtagttgggagagaaaccatatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacatgacactgggatcctctagatcga

SEQ ID NO: 466563 - DNA, 1348 bp, Homo sapiens
gtaagctgtctttgcttggccatcttgggctagcaggccttgcagagaactacctttttagctgagtgaagggatcaacctgagttggagttctcctatgctgtggccagatccactagaaattaacccagaatcttagcctctcagtggcctatcggtgatgccacactcaatcagaaactatgctactgctgaagaggtatattgagccctgcctggttaacctccagtgaggttattagagaattgggagaggctcaaatcagcatcctgcacctggttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacgcagttgtgttcatccattattgtcgatggcagctttcatgctacagcagagttgagtagttgggagagaaaccatatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacatgacactgggatcctctagatcga

SEQ ID NO: 466564 - DNA, 1853 bp, Homo sapiens
tggcacaattttaatcaattgttctgcaaaaagttttcttctcttccttgctgatgcagagggccaaaatgttaccttcttcaaaccagatccttacagtctttggcgatgtggccgcttctcccacagttgtagcagatgtttccgagaaggacacagttcttagcattacgaccggactcaccacagcagtaacaggtgtctcagtgatgtcatacaaggtttgcacacggccccattcacgtgtcacggacattcctgacgcccttcccgcccgactttcctcctactcaagaagccaaaagcacaataatctgttaactgagaggagaggagtaagaggcccaagagggctgcagactggcagggaaagtgaagaattgaagggtagaccactaacgatagcagaggaaataaaggtagatgcagcgcatgcgctggaagcacactgcggcgattctggagaggttgtccttttctggcatcagcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggaggtgatgccacactcaatcagaaactatgctactgctgaagaggtatattgagccctgcctggttaacctccagtgaggttattagagaattgggagaggctcaaatcagcatcctgcacctggttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacgcagttgtgttcatccattattgtcgatggcagctttcatgctacagcagagttgagtagttgggagagaaaccatatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacatgacactgggatcctctagatcga

SEQ ID NO: 466565 - DNA, 1223 bp, Homo sapiens
gaaaagtagttaatggcagtggtggtatgaaggtgatgccacactcaatcagaaactatgctactgctgaagaggtatattgagccctgcctggttaacctccagtgaggttattagagaattgggagaggctcaaatcagcatcctgcacctggttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacgcagttgtgttcatccattattgtcgatggcagctttcatgctacagcagagttgagtagttgggagagaaaccatatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacatgacactgggatcctctagatcga

SEQ ID NO: 466566 - DNA, 352 bp, Homo sapiens
ttcccctctctggcttttttgcatatttctgcagatgtcttgacctttctggggagtaagcccccttagaagattaattttctgtagttctctattgaggaaatacatgacatttagctttttaataatttgatgccattcattgagtacctactgtgtgctttatgtaccctgtctcgttgaatttttacaaaaaactgaaagagttagttttgtgttattactacctccatctcaaagatgagtcttggaaagcttaagtaactttaggtcacattgtaatcagtggcagaactgggacttaagaacataattcatgactgcattttcttttctttctttctctttcttt

SEQ ID NO: 466567 - DNA, 305 bp, Homo sapiens
tagagatgggggtcttaaactatgttgcccaggctgttcttgaacacctgggctcaagtgatccacacaccttggactcatttcacactaaaagattctgtaatagctcctgagattttactcctctgatgttggaaatttccatagtgtgaagttttgttatgcataaaatcacctggggtgcttgttaaacatgcagattcctggatggccagaaaacttgtcattggtcaagagcaacattaagatctgcctgttactcatactgatgcttcctgcccagcaagttcatcagagggcgagga

SEQ ID NO: 466568 - DNA, 2059 bp, Homo sapiens
tggcacaattttaatcaattgttctgcaaaaagttttcttctcttccttgctgatgcagagggccaaaatgttaccttcttcaaaccagatccttacagtctttggcgatgtggccgcttctcccacagttgtagcagatgtttccgagaaggacacagttcttagcattacgaccggactcaccacagcagtaacaggtgtctcagtgatgtcatacaaggtttgcacacggccccattcacgtgtcacggacattcctgacgcccttcccgcccgactttcctcctactcaagaagccaaaagcacaataatctgttaactgagaggagaggagtaagaggcccaagagggctgcagactggcagggaaagtgaagaattgaagggtagaccactaacgatagcagaggaaataaaggtagatgcagcgcatgcgctggaagcacactgcggcgattctggagaggttgtccttttctggcatcagcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggagtcagcatgaataccagcacagcccaactatgtgtaagcagatctgtgcaggaatgagagtcccagggagagaatccacgttgtttctgaaagaaaatggctatagctcactgttgtttactggaaatagtagggggaaggaaagatggaagtccaggtccagtgtcatatactgccctgcaccttactcacttctctgcctttagggtgatgccacactcaatcagaaactatgctactgctgaagaggtatattgagccctgcctggttaacctccagtgaggttattagagaattgggagaggctcaaatcagcatcctgcacctggttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacgcagttgtgttcatccattattgtcgatggcagctttcatgctacagcagagttgagtagttgggagagaaaccatatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacatgacactgggatcctctagatcga

SEQ ID NO: 466569 - DNA, 1194 bp, Homo sapiens
tggcacaattttaatcaattgttctgcaaaaagttttcttctcttccttgctgatgcagagggccaaaatgttaccttcttcaaaccagatccttacagtctttggcgatgtggccgcttctcccacagttgtagcagatgtttccgagaaggacacagttcttagcattacgaccggactcaccacagcagtaacaggtgtctcagtgatgtcatacaaggtttgcacacggccccattcacgtgtcacggacattcctgacgcccttcccgcccgactttcctcctactcaagaagccaaaagcacaataatctgttaactgagaggagaggagtaagaggcccaagagggctgcagactggcagggaaagtgaagaattgaagggtagaccactaacgatagcagaggaaataaaggtagatgcagcgcatgcgctggaagcacactgcggcgattctggagaggttgtccttttctggcatcagcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggaggtgatgccacactcaatcagaaactatgctactgctgaagaggtatattgagccctgcctggttaacctccagtgaggttattagagaattgggagaggctcaaatcagcatcctgcacctggttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggattatgaagtattaattcttccactgatatctcaaaaggtgatctggacaaaggaacaggtatctcagattcccagttctcaatcttccttcctccttacaagatacaagcaaccttcaaccttccca

SEQ ID NO: 466570 - DNA, 970 bp, Homo sapiens
cacaacagcgtcttcctctaaaaatggtttgtcttttacattttaatgcaggaaaggatccagtccgtgatgaatgtgaggaaagaaacccttttacagaaacaagggaggaagatgtaactgatgagcatggggaaagagaaccttttgctgaaaaagatgaacacacggggcagaaacgtgattatagacatactcggaagttgctgaatgtccttaaagaatacatcgcagagaagcagaaagatgatgaagcagaagaagcagaagccgcagcagcagcagcagaagccgcagcagcagcagaagccgcagcagcagcagcagaagtaatagtagtagaagacgaagaggaggaagagaaggaggaggaggaggagaaagaagaggaggaagaagaaggagaagaagaaggaggaggagaagaaggagaagaaggaggaggaggaggagaaggagaagaaacagaagaagaggaagaggaagaagaagaagaggaagaggaagaacaaattgttgaaagcatttcaagaaaaacagaagaggtggcaacaacctacaggtgttaggagctggaggctgagagagatgaagccgctacttgagcaattactaaaggctgccaaggacactaaagacaattattgcatcatttcttccagtgaagaaagtgaacttgataactagccgtgtttttaaaaagaatcgtgtcagaactcttttggaagagttggcacttcattgtctcttcaacctctgttattctgatgactgaagaaagaacttgaacctatgttatatgatacgagcacaacttgagctacagtaaactacatgacagtgttttgataattgttgtataaatcggtatagctcctctgtcacttgtctgttaaatgccagacctcgtttctatgatctgttgaatgaatcctagacacttctgaaaattagtttaaaatgtactaaa

SEQ ID NO: 466571 - DNA, 1655 bp, Homo sapiens
atccagtgggtccagaaggcaggactgctgctccacagggtctggaagcatggaatgcccctcagcagatgccaatactatgctcttggacttcctagtttccagaagtttgacggagctgtgagaagagggcaactgtcctccataccctacaatggtatattcactgactgcttgcacactgcacctggaaaagccacagacacccaacaccacaacatgaaagcagccaggagaaaggctgtaccctgcaaagtcattggggtggagctgcctaagaccatgggaactcacctcttgcaacagtgtgacctggatatgagacctggagtcaaaagagatcattttggagctttaaaatttgactggcaatgcaaagggaaaatgtggggttgtagcttccacacacggtccccactggggcctagtggagctgagagaagagggccactgccctccagaccccagaacagtagatccactgacagcttgcactgtgtacctggaaaagccacagacactcaataccagccacaaaagcggccagggcagaaagttatattctgcaaagctacaggggcagggctgtccaaggccatagtagcccaccttttgcatcagtgttctgtggatgataccagctcagccacagaaaaatggggcactgatcggattcattaggcctctgttctaggctctagctctcagacagcatttctagacactgggccaaagggaatctgcttccttgaaggaaaagacccagtcctcgcagcattatcacccattaactgaagagctcttaggctctgaataactcacagtgatacccaggtactatgttaaaggccttaggtgagcctctgacacttggtggcttcagtgcactctttgaattttcagaattatattttatttcatttgtggaaagtaccctgtattattagtttcattatttcctctacttaatttttaatattttaattttcttccaataactcttaaatttggtctattgagtctattttttagaatttgtaggcatgctccatttttaaaatttgttttgcttttgtcttttctgtgtattttcaaatagcttgtcttcaagctcattaattcttctgctcgagcaattctgctattacaagactctgatgcattcttcagtatgccagttgcattttacaactccaatattgctgcttgatttttaaaaattatttcaatgtatttgttaaattcatttgatagaattctgaatttcttctttgtgttatcttgaatttcttggaatttcctcaagacagttattttgaattctctgtctgaaaggccacatatttctatttctctaggattggtcagttgtgccttagtatattttcctggatggtcctgatatttctcgatgttcatctgtgcctgagcattgaaaagttacatatttattatagtcttttcggtctgtgcttctttgtgatcatccttcttttcaaagctttgtaggtattcaaaaggacttcagtattgtgttcttatttttttctttttcttttaaattttttttattattatactttaagttttagggtacatgtgcacaacgtgcaggtttgttacatatgtatacatgtgccatgttggtgtgctgc

SEQ ID NO: 466572 - DNA, 3267 bp, Homo sapiens
ccggaagcggcggcggcagccgaggcgacgcaccgtgaggcagctgcttgactaggccgcagccgccatggcgatgaactttggggaccatgccagcgggttccgccatgatgatgtgatcaggttcatcaacaatgaagtcctcaggaacggcggcagcccagccttttacacggccttccgctcgcggccgtggaacgaggtagaggaccggcttcgggccattgtggccgacccgcgggtgccccgtgccattaagagggcctgtacctggagcgctttggcgctgagtgtgcaagtggctgcgaggcagcaggaggagctgctgtaccaggtttggtggctgcaagggcatgtggaggagtgccaggcgacctcctgggctctaacttcccagctgcagcagctgcgcctggagcatgaggaggtggcaacacagctgcacctcacgcaggccgccctgcagcaggtgctgaatgagcgtgatgggttatgcgggaggctgctagaagttgagagatccatgcaggtctatccgatgcctcaggattttgtacccggtccagaagccggccagtatgggcctgtggccgggactttaaatgcagaacagagtgaggcggtggccacagaggcacagggaatgccacattcggaagcccaggtagcagccccaacagctgtgtattacatgcctgaaccccagagtggcagggtccagggcatgcaacctcttctgctaatgcaggcacctcatccagtcccattccatatgccttcaccaatgggactgccatactcaacacctctaccacccccagtagtaatggaatcagcagcagcaattgcaccacagatgcctcctgcagggatctatccacctggtctttgggccacagtgggatcccaggaggagacggcccctccgtgggaccagaagtgccatggccaggatggatatcctgagaatttccagggagtatatcacccaggagataacagaagctgcaaccaaaaggaaggttctgagtgtccccaaggaatgacttcccaaggggacagcagcagccacagcctgaagaaagatccagtgatgcaagagggcacagctcccccagagtttagcaggagccacagcctggagaaaaaaccagtgatgcccaaggagatggtccccctaggggacagcaacagccacagcctgaagaaagatccagttgtgcccaaggagattgtccccataggggacagcaacagccacagcctgacgaaaaatccagttgtgcacaaggagatggtctccctgggggacagcaacagccacagcatgaagaaagatccagtgatgccccagaagatggtccccctgggggacagcaacagccacagtctgaagaaagatccaatgatgtgccaggagatggtccccctgggggacagcaacagccatagcctgaagaaagatccagtggtggcccagggcacagctcccctgatgtatagcaggaggcacagccagaagaaagtgccaatgatgcccaaggagatggtccccctgggggaaagccacagccacagcctgaagaaagatctagttgtgcccaaggagttggtccccctgggggacagcaagagtcacaggatgaagaaagatccagtgatgccccagaagatggtccccctgggggacagcagaagccacagcctgaagaaagatccagtgatgccccagaacatgatccccctggaggacagcaacagccacagcctgaagaaagatccagtgatgccccagaacatgatccccctggaggacagcaacagccacagtctgaagaaagatccaatgatgcaccaggagatggtccccctgggggacagcaacagccatagcctgaagaaagatccagtggtgccccagggcacagctcccctgatgtttagcaggagacacagcctgaagaaagtgccagtgatgcccaaggagatggtccccctgggggacagccacagcctgaagaaagatccagtgatgccccagaacatggtccccctggaggacagcaacagccatagcctgaagaaagatccagtggtgccccagggcacagctcccctgacgtttagcaggagacacagcctgaagaaagtgccagtggtgccccaggggacagcctccctggggttcggcagaatccacagcctgaagaaagagttagtgatgcccgaggagatggtccccctgggggacagcaacagccacagcatgaagaaagatctagtgatgcccaaggagatggtccccctaggggacagcaacagtcacagcctgaagaaagatccagtggtgcaccaggaggtggtctccttgggggacagcaacagccacagcctgaagaaacatccagtgattccccagggcacagcctcactgaggtttagcaagagccacagccagaaggaagatcaggagaggccccaggcaacccctctggaggatagcaagagccatggtgtgaaaaatagcccatggaaacaccagcctcaggggcagaaggtcaaggaacaaaaaaggaaaaaggcctcagaatcccagcaacagaagcctgcctcatgctccagcccagtgaattgggcctgcccatggtgtaatgccatgaattttccacggaacaaggtgtgctctaaatgcaagagagtccgtatgccagttgagaatggcagcgttgacccagcgtaaactcattgatttcaggaagaaggatagctattttcctggttgcccaccagcctgcctgaaagacctggggtgtcttgaagaaaaacagtgctttggggagtgttcactacacacgctagctttcagcctcaggctgcccccatcccaagtcccttttcagtcagcagtggatgaagaacaaaatggattccaaggacaaacattgggggcaccaggttatggatggtgtttctcttgggaggataaattgggttaaaaatagagctagactggggcaagcacttttgggaataccccaggacccccacctctccctctttggtgtgttctctgcaggcttacccaaggcaactgctgcaaggcaaggaaggagccagggtggagcccaggggtggttggttagatctgccttcaatccaagctaaagatgtccttgagtttcccaatgagatcccacccagctcaccaaaatcaatgtttgtcagggattttctgggcctaactagtaataaagaatgtgcatttga

SEQ ID NO: 466573 - DNA, 1294 bp, Homo sapiens
ctcaccagatgcccagtgatccagccagcagaattgatttgttacttgatctccatgtgtatatgcaaatatttgcctgtatttattgtcatcatcatactttgggcactggccatgctacctctgtgaggaaagaagggaaaggaaaggaaaaataagaaaagaagaaaacatccatacagggtctcactctgtcaccaggctggaatgacagactgataggcagactcacatagccttcttgcctttccctgaggagttgactccaattgtcctacacattccttctctatgatatagaagccctgggtctcagcggtaatggcctgggattcaccatctcctcttgtggccacctgagacatggcttctgttcctaagcccctattaaatgttcctttcagagaaaatggatatgtcagcctctttcttccgcctctcagctccctcagacttctcttcctgtatttttgacacctttgtgattctggaaagattgctttactccacaacaatgaacacttggttctccagcgctggcttggttctgcaacttccagctcccttgaacactcatctctgccctgttgagaatgccaacggctctgctcacagcgagtggcagctccacagcacagttcacaccagaaacctggcggcatccgtggatgaaatgatctctcctcctttctctagaggtgcaatgaaattaagcaataaacaatgcatcctaaaatctgaatcttcagggtacaagaaaagaaagacacttggaaattcacactacagtaaaacccatcaatattcatggcagggaaagttcaaataagaaaatcttgaattaactttagataaatatcaagtgtgaaattcatcaaaataattggaaatcgtgaaaacctataccatgatgtgatcatggctcccagttccatggactgtctttgtcaataaaagcaagactgattctaattacctcttatattttgtcgtgctatttcattgtctgtaatgattccatttattgataaccattaatatttattgaacttttatgatgcttaatgctgtatatttgcttaggtgataatataatactgcatgtgtaaattgataaaatgtaatgtacagtgccataagtgagtaaaatagtgttgaagaggaacctgcctagaaaaacaatgtgcagggctgtgctgttcaatatggtaaccacccttatggttatttaaatttaaatataaattaattaccattaagttaaataaaagattcagtccctaagatgcatcat

SEQ ID NO: 466574 - DNA, 749 bp, Homo sapiens
agggggtgaggtcactaccagagtaccagaggatagagccgcggcacagtcctgagggatttacagctggaggggaattttacctcaggatggaccatggcccaaactttacccatccctgaattagatgagattttgaacataacgttgatgctggaatgcgttaagacttttccggcagccaggagaagaccaagacacaccagaagaattccatctgacaatgaaggcagagattggggttatgcaattgcaagccaaggaataccaaagattgctggcaaaccaccagaaactacgaagaggcaaagaaggactcccctacaggtttcagagaaaaagcaaggttctgcccactcttgtttaagacatctagcctccaagacagtgagacagtacatttctgttgttttaagctacccagtttgcggtactttgtcatggcagccctgggctctgcctccacttcaggctgccttcatctgtggttcccctccttaccccagttaagcaccaacatctagagctacacctctatttggacacctatcttgctccaacccacctcttgaattgttctagaaaagtttatcttgatttatttataatgttttgaatatatcacttcgtatagttttcttaatagttgctctaggaattacaaaatatatatatagtttaccacaacctactggtattaatattttaccactttgaataaagtgtagaagccttatttccatttatgt

SEQ ID NO: 466575 - DNA, 6408 bp, Homo sapiens
ccgtccgctgacgtagagggccggaggtggcggcggcggcggcggaagcggcagcggcagcagcggcggcggcggcggcagcggcggctgctgcggcggcggccgcggcggcggcggcggtggcggcggcggcggcggcggatgcctgcgtcccaggctcgcgggcggcaggcccgggtgagtgcacacccggcgcgcggccgggctcccggatgtgttacctggtcccgctgcagccgagatgccaggggagcggggccttccacacccctccgtgtgtgcgtgacttgtgcatcacggacaattttgctgagggagatttcactatggcggattatgccttgttagaagattgcccttacgtggacgattgtgtctttgctgctgaatttatgaccgatgattatgttcgtgtgactcagctttactgtgatggggtgggtaagcaatataaagattatgtccaaagtgagaggaatttagaatttgacatctgcagtatatggtgtagtaaaccaatttctgtcctgcaagattattgtgatgccattaaaataaacatcttctggccacttctgtttcaacatcaaaacagttctgtaatatcacgattgcatccctgtgtggacgccaacaattcacgtgcttccgagataaatttgaagagattacaacatcttgagttgatggaagatattgtggatttggcaaagaaagctgctaatgattcactccttattggaggcttattgagaattggttataaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaacccaaagttgtatggattgtatagagcaaggagaactaatgaaaatgaaaggaaatgaagagttttccaaagaaagatttgatatagctattatctattacaccagagccattgaatatagacctgaaaaccaccttctttatggtaaccgagctctttgttttcttcgtactggacagtttagaaatgcacttggtgatggaaagagagccactattctgaagaacacttggccaaagggtcattatcgttattgtgatgctctttctatgctgggggaatataactgggccctgcaagcaaacataacagctcaaaaactctgtaaaaatgaccctgagggaatcaaggatctaattcagcagcatgtaaagttacaaaaacaaatagaagacctacaaggtcgaacagcaaataagaatccaattaaagccttttatgaaaacagggcctacacacctaggagtttatcagcacctgtatttagtacttcacttaactttgtggagaaggaaagagatttcagaaaaattaatcacgaaatggctaacggtggtaatcagaatctaaaggtgatggatgaggcattgatggtagatgattgtgactgtcatcctgaattttcaccaccatcaagtcagcctccgaaacataaaggaaaacaaaaatctcgaaacaatgaatcagaaaagttcagttctagttcacaattgactttaccagcagatttgaagaacatcttggagaaacagttttctaaatcttccagaggtgcacaccaggattttgctaatataatgacaatgctgagaagcttaattcaagatggctatacagccttattggagcagcgttgccgcagtgccgcacatgcctttacagagttgctgaatggtttagatcctcaaaaaataaagcaattgaatctggccatgattaactatgtcttggttgtctatggacttgccatttcactccttggaataggacagcctgaagaactatctgaagctgaaaaccagtttaagaggattattgaacactaccacaatgagggacttgattgcttggcctactgtggaattggaaaagtatatttgaaaaaaaacagatttctagaagctctcaatcactttgagaaagcaagaaccttgatttatcgtcttcctggagtgttaacttggcccacaagtaatgtgattattgaagagtctcagccagaaaaaataaagatgctgttagagaaatttgttgaagaatgcaagttccctccagtgccagatgccatttgttgctatcagaagtgctgtggatattctaagatccagatatacataactgatccagactttaagggttttatacgcatcagctgttgccagtactgtaaaatagaatttcacatgaattgctggaagaagttaaaaaccacaacctttaatgataaaattgacaaggattttctacaaggaatatgtcttacccctgactgtgaaggtgtcatttctaagattatcatcttcagcagtggtggtcaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaaattagcacaagaaagaatggaggaggacttaagagaaagtaatccacccaaaaacgaagagcagaaagaaactgtagacaatgttcagcattgtcagttccttgatgacagaattctacagtgtataaagcagtatgctgacaagattaaatccggcatatggaatacagccacgcttctcaaagaattactttcttggaaagttttgagcacagaggactatacaacctgtttttcaagcagaaattttctaaatgaagcagtggactatgttattcgtcacttgattcaagaaaagaacagagtaaagacaagaatatttctgcatgttttgagtgagcttaaagaagtggagcccaaattagccgcctggatccgaaaacttaatagctttggcttagatgccacaggacctttcttttctcggtatgaagcatctcttaaacagcttgattttagcatcatgactttcctctggaatgagaaatatggtcacaaactagactctatagaaggaaagcaacttgattatttctttgagccaacatcatcgaaggaagcccgctgtttaatatggctgctagaagaacacagagacaagttcccagcattacatagtgctttagatgaattctttgatataatggacagccgctgtactgtgttaaggaaacaagacagtggcgaagcaccgtttagttctaccaaggtgaaaaacaaaggcaagaaaaagaaaccaaaggattcaaagcctatgttagttgggtctggaacaacttcagtaactccaaataatgagatcatcacttcaagtgaagaccatagcaatcaaaattcagatactgcaggcccatttgcagtgcctgaccatcttcggcaagacgtagaagaatttgaagctctctatgaccaacacagtaatgaatatgttgtccgcaataagaagctatgggacatgaacccaaaacaaaaatgttcaactctatatgattacttctctcagttgttggaggaacatggtcccttggacatgagtcacaagatgttctctgaagaatatgagtttttcccagaagaaactcgaccaatactagaaaaagcaggaggtttaaaatcttttctcttgggatgtccccgttttgttgtgattgacaactgtattgcattgaagaaagttgcatcacggctcaagaaaaaaagaaagaagaaaaacattaaaacaaaagtagaagacatttcaaaagcaggagagtatttacaagttaaactaccacttaattcagctgctagggaatttaaaccagatgtaaagtctaaaccagtatcaggttcatcttcagcaccagcttctgaagatgtgaaacccaaacctttgtctgcaaattctcccaagccagcttgtgaagatgtgaaggccaaaccagtatccgataattcttctagacaagtttctgaggatgggaaacccaaagggttctcttctaattctcccaaaccaggctctgaggatgcaaattacaagcgagtctcctctaattctcccaaaccggttcttgaggatgtgaaaccaacttattgggctcaatcccatttggtcacaggatactgtacgtatcttcctttccagagatttgataacacccggacatcgccagcatacataaatgtgttaccaggtttgccccagtacaccagcatatatacacccttggtcagcctttctcctgaatatcagctaccaagatcagtaccagtggtgccgtcttttgtagccaatgacagagcagataaaaatgctactgcctattttgagggtcatcatttgaatgctgagaatgctgctggtcaccagattgcctccgaaacacagatccttgaggattcttcgttaatatctgtaaagtcacagtgcagcacaggtgatgctcatacagtcctgagtgagtctaacagaaaagatgggcactgtggaaattctaacaacaaatgtgaagtaattccagaaagcaccagtgcagtaacaaacattccacaggtgcagatggttgccatacaggtatcttggaacataacacaccaagaagtcaatactgagccatataatccttttgagaaacaacaaggggaaatttcacggattgaaaaggagtaccaagtattacaagaccaacttaaagaagcgtatgaaaattatgagcagataaaacttaagggcttagaagagaccagggacctggaagaaaagttgaaaaggcacttagaagaaaacaagatatcaaagacagaattagattggttgcttcaagatttggaaagagaaattaaaaaatggcaagaggaaaaaaaagaaatccaaaaaacactaaaatcactgaagaagaaaattaaaaaggtttcaaatgccaatgaaatgtatacccagaaaaatgatggaaacgataaggaacatgaattacatctggatcagtcccttgaaatcagcaacacacttacaaacgagaaaatgaaaatagaagagtgtataaagaaagggaaaaaggattatgaagagagtcatcagagagctgtggctgcagaggtatccgtacttgaaaactggaaggagagtgaagtgtataagctacagatcatgcagtcacaagcagaagcctatctgaagaagctggagctgattagccatgatcctgcagcatatcctgacatggagtccgatatatgttcatgggaattgtttctttctaatgttacaaaagaaactgagaaagcaaagtatcagtttgaagaacaaattaaggcaattaaaaatggttctcggctcagtgaactttctaaagtgcagatttctgagctttcatttcctgcctgtaacacggttcatcctgagttactccctgagtcttcaggccatgatgaccaagggtttatgacttccgcaagcgatgtgactggaaaccaagcagcacttcacagggatcccagtgtgttctctgccggcgattccccaggggaggctccttctgcactgttgccagggccacccccctctcagcctgaagccactcagctgccagggccaaaaggggctggccaggcagctctgtcagagcaaagccctgcggctgatcagaagcagcctgttcctccagggtgtgctgcatgttcaagccagtctccaaaaaagccattcaatagtattattgagcacctgtcagtggtattcccatgttacaacagcactgagcttgctggttttattaaaaaagtgagaagcaaaaacaagaactcactttcaggattgagtattgatgaaattgtccaaagagtgacagaacacattctagatgaacagaaaaagaaaaagccaaacccaggaaaggacaagaggacttatgagcccagctctgccgcccacgtgaccaggtcctcccagggcccacccttggcggttgttgcaccatcacccaaaaccaaggggcagaaagcagaagatgtccctgtgagggttgcactgggtgcaagttcctgtgaaatatgtcacgaggtgttcaaatcaaaaaacgtgctttgcagcagcaagtacaaaaggagaataggaatatctgtcgaatgagtgtgttttgtacataacttcagatacttgtgaacatgccttatatttgtccaacaactgtcagaataaagaacattctaaaacgagcaaaaaaaaaaaaaaaaaaaaaaaaaagaaagaaaaaagaaagagttaaaagcaaaaggtgataagttac

SEQ ID NO: 466576 - DNA, 3922 bp, Homo sapiens
tggcttttttttttttttttttttggcatgtcaaacaaaccttcaggccacagctaatcaaagagagttaattttcctgaagggaagccgtcggatagtccaacaagacatgtgagatggctcccattcaaaaagctctgtccccaaggaatgtgctgagcaagtcagatactcactccaaaaaacctgaaatgggaattatatgggcaattgaggttgccaggtacaggggcctcctgggtgctcttttgcggggaacgctgcctggacactcctgcgtcggtgactatttacctgcagtccagcatcgaacagtggctgtgaggtggagaaaaggtggggaatggaggctgagaaagcagcaggtagggcaagaaggagccaaacccacaggagcagaggctaataacagtcaacctcctacactccatggccacacaacagaagagacagaatttaggatacagagttacatgcagataaatctcactattatactgagtgagaaaacaagtagcacagaattatgtaccaaatagttactcaattgtgccaagcagtacttggatatatacatagacatttaattcacaggccccaaaacagaacctgagaagataaaagcaaagtttgtcctccccaacaatatcaatagaagttgaagcacatttgacaaattataacattcattcatgataaaaaaatttcagcaaaccataaataaaaaggaactttaccaacttgataaaaagcatctatagaaaacctgcatataacatcaggcttagggaaatgccagttaaaacccaggaaataccactttaccacctaaaatggttaaagtaaagggacattaacacattttagtgaggatgtggagaaattagaatcctcatacactgctggtggagcagccattttggaaaacagtctgatagttccccaaacagttaagcagagttaccatatgaccccaaaattccactcatatgtatacacccatgacaagtaaaacatgtgtacacacaaaaacttgtataataatcatagtgtcattaatcacaataatataaaagtggaaacaacccataagtacatcaacttatggatggattaatgaaatgtgatatatccatacaatggaatattattcagcaataaaaagaaatgaaataatgatacatgctgcaacatggatgaaatttgaaagcagtatgctaagtaaaagaagccagacacaaaggacaacatatggtatgattctacttgcacaaaaaatccacaataggcaaatctataaagaaaaaagatttatggttacctagggctgagtttaccaaagagaaccagggaaagaaacagtaaagaagatttctcctgggatcagaacaaacctcaaagactttcgctaaaaaccacatttccaaagggactgaaatttaaatggatcaggctacagaacaatgtatactctaaggcattgtgaaaacaaagagctctatcagcaggcaattagtgagcctaaaaaggtgtgatcatagaaaaagatagtcaaagatagccctactaaaaccactgtcatctcaggatgactgtgcacatgctgaagttcatgtgcacatgctcaagttcaagaacaacatcaggggctttctgctagggggtgggggacaacttcaataaaatagtctagccaagtcactaaacaaacaagcaagcaacaccaacatgaggaggtgtggagggggcggcgtgtgcgggatcgtggaggtggggccgaggcagcggccgcctgagccccgctcggccttgggaacacgggggcggggcggccgcggctctgggcgacccgctgggtgcactagtgctcgggtcccaccgccctgaggctcgcgctcgagcgggtcagtcggtcggcggggcctgcgcggggcccgggcccatggcggcgtcggcggctctgtctgcagcggcggctgcggcggccctgtctggcctggcggtgcggctgtcgcgctcagctgcggcccgaggctcgtacggcgccttctgcaaggggctcacgcgcacgctgctcaccttcttcgacctggcctggcggctgcgcatgaacttcccctacttctacatcgtggcctcggtgatgcttaacgtccgcctgcaggtgcggatcgagtgagcgccggcggcggcggcggcgaaggcccggctgaaggggcgcccgtgtccccgcccgcccccggccgggtcgccggcatgaaggaaagctgggccgcggcggggggcggaggcggggcggctcggacccctggactctagacctacgccgccagggcacgacggcccagccctggccccggctgcggtctcagcccgggggccctggatcgcgcagaaacgcactgaatgggcccctgccatcgggctccagaaactacctgggctcggccgacctgttgcctcatattggccaaagagggggaaaccagaaggagggaattctgctgcggcgacttgactttccaggcccggagcagaaaggcattggcatttgtaggcggtgacccgccccttctctggccttgccaagagtcacatccctgcccaggggcacctctggccctggaacttgcctgggcagaggcagcgtgaagggcctgaacaagaggagaagaagggccttcctagtagaggcacagcatggacaaaggctcacaggggtgggggtgcccagtgatcgagtcctggcttgggaaggaaggtctgagttccctgggaactgaaatctgctagcagcactgtgagagaggtgtatttccccctcctaatgacagaggaaactgaggcttcagggaggggtggatttgcccttgacatgcagataggaggaggaggaactgcgtgtgcccctgggcctgcaggcccccacacccctccccagtcttcttcaagacctggcatggtgggaggagggagggggaagtggagaggggagcatagggctcctggggcaccaagggagagaggggcccaggggtagggaatctaggaatgtcgctttccttggagcagtacggaaagtcacagggaagatcaggaggacggacagctgagatgggagacaggagagatgagccccaggacccctggggagccaagctgtcccccacatcctagcctctcaccccacctggagcttcaccaagggctcctcagcagtgaagtggcacaagcctcccagtttggtgggcaagtgggggtgatcttggtgttgtggctcctggagacacgacataaccaggagggtgaagggataaacctggggtgggctggggctgagacccatggcatgaccccaattctctctcctcaagctcgaccccccatccccaggatcacacaggagaatctcatcctcacggcttggattgctcctgggggccccctggtgtgctgctaactggtgtacaatgctcaggagcagcccagaggggagccgggaagggaccctcgcccttaccatctatccccatttccgcatctcttgcactggtaccccgggcgccacgttctcagttcctgggactgaaaactgcagcagtctggccagctccagggacagagtggcccagccacctactatgtaccctcctcagctgcccactggactcaggtcctgaatgaagctgtccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaacgtgaggagcgtctctgcccgccgccatcccatctaggaagtgaggagcgcctcttcccgccgccatcctatctaggaagtgaggtctca

SEQ ID NO: 466577 - DNA, 5520 bp, Homo sapiens
gcctaacctccactgttacctgacttcaaagcttcaaaggataggccgactctcttattagagttgaagccaatgcttatttaccattccaaaaatcctggggcctttaaaaactatgctaaatctactctgcctgtgctctataaatggaaggacagaacttggatgacagcacatctgtttacagtatggtttactgactattttaagcccactgttgagactttctgctcagaaaccagagagattcctttcaaaatattactgctcattaacaatgcatctagtcacccgagagctctgatggaaatgtacaaggatattaatgttgttttcatgcctgtcaacacgtccattctgctgcctatgaatcaaggaaaattaccacagccactccaaccttcagcaagtaccaccctgatcagtcagcagccatccacatggaggcaagaccctacaccagcaaaaaaattaccactagatgaagcctcagatgatcattagcattttctagcaataaagtatttttaaattaaggtattccctgttgtctcattggcggctttctgagcagctgcaaaatatgtttttaacttttaagtggaagttgggggtcactggcatcgagtctggaacagtcattctcagcaagagctctttgaactctgacattctctagttttacggactcggaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttaaattagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcggtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttaaataacatatggtatttggcaaatagatttatttttcaaaatgtctcactagtttccttttacacaatgtatatacttcaagatgtatagaaaggaaagctacagttgagcccttatacatgttttaaggtagaaatatgttccctattgtttgaaaactgattgtaagaataacctcagttaggagatataacttgaagtgtcagtccaaactactgatttaaccctatttacggtaacacattaccttcctcacctcctgtttggccctggagaatgtagtcctttttctcatttgtgttgagaaatgaaaagtctgctgtagaatgtatctgatgtcattagttcttcaaatggataccattgtacatataacagtagaatttggtttggggttgttagtgaaaaaaaatttaaacctgccattaaaaatccccatgtttcatggaaatctaacagaaatacattgtaataattagaacattttgttttcttttttcttttttttttttcgagacggagttttgcccttcttgcccaggctggagtgcaagggcgcaatctcggctcgctgcaacctccgcctcccgggttcaagcagttctcctgcctcagccccctgagtacctcagatgacaggtgcgtgccaccacacccggctaatttttgtatttttagtagagacggggtttcaccatgttagccaggctagtctcgaactcctgacctcaggtgatccacccgcctccgcctcccaaagtgctgggattacaggtatcagccaccgtgcctggcctaataattggaacattttcatcatgaaaatgtcatcagctttgccaaaagaaacaaccaattgacttgtttggcgtttgttttccattttcatgtcaattttatgtatacagttagaatacccaaggagaccactaaaatcagttaaacaagtagggtatatacaaagaaagatgaaacccgaaagtacataaaaaggatttaaatccgattttagatgtacctagtgtgtatttcttatctctagacaagttcatgtttattgtttaatttatgcccaagtgaagttgtaaacttatggttcaactctgacacagaatttgtcacttgtctgaggtcagtggcaggtttctctgctgtcaagcactctgtgtcacccaccagattagtataactattaattcagactgtactcctatgtttaagataatttttacaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgctactttgctgtgtcctgattcaattaatgttttattaaccgctgtgtttttaaaaatttgtttgcctgcttctcattttataacatgtagaatatgtacagagctcactttaaaaaatttgttcgttggcctctgtttgtgctatgtagattatatagagagctgtcaaggataagtttttatgcagtaaatgtcaaccagaaatgctcaaactgattgggagtgtgggggaggggtgttgagctgtaaagggctggttatacttc

SEQ ID NO: 466578 - DNA, 4674 bp, Homo sapiens
gagcgcggccgccgagcccagctccgccgccgagcgcctgtgccggcacggctacaccatggagcgcccggataaggcggcgctgaacgcactgcagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttaaattagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcggtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttaaataacatatggtatttggcaaatagatttatttttcaaaatgtctcactagtttccttttacacaatgtatatacttcaagatgtatagaaaggaaagctacagttgagcccttatacatgttttaaggtagaaatatgttccctattgtttgaaaactgattgtaagaataacctcagttaggagatataacttgaagtgtcagtccaaactactgatttaaccctatttacggtaacacattaccttcctcacctcctgtttggccctggagaatgtagtcctttttctcatttgtgttgagaaatgaaaagtctgctgtagaatgtatctgatgtcattagttcttcaaatggataccattgtacatataacagtagaatttggtttggggttgttagtgaaaaaaaatttaaacctgccattaaaaatccccatgtttcatggaaatctaacagaaatacattgtaataattagaacattttgttttcttttttcttttttttttttcgagacggagttttgcccttcttgcccaggctggagtgcaagggcgcaatctcggctcgctgcaacctccgcctcccgggttcaagcagttctcctgcctcagccccctgagtacctcagatgacaggtgcgtgccaccacacccggctaatttttgtatttttagtagagacggggtttcaccatgttagccaggctagtctcgaactcctgacctcaggtgatccacccgcctccgcctcccaaagtgctgggattacaggtatcagccaccgtgcctggcctaataattggaacattttcatcatgaaaatgtcatcagctttgccaaaagaaacaaccaattgacttgtttggcgtttgttttccattttcatgtcaattttatgtatacagttagaatacccaaggagaccactaaaatcagttaaacaagtagggtatatacaaagaaagatgaaacccgaaagtacataaaaaggatttaaatccgattttagatgtacctagtgtgtatttcttatctctagacaagttcatgtttattgtttaatttatgcccaagtgaagttgtaaacttatggttcaactctgacacagaatttgtcacttgtctgaggtcagtggcaggtttctctgctgtcaagcactctgtgtcacccaccagattagtataactattaattcagactgtactcctatgtttaagataatttttacaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgcta

SEQ ID NO: 466579 - DNA, 5256 bp, Homo sapiens
gcctaacctccactgttacctgacttcaaagcttcaaaggataggccgactctcttattagagttgaagccaatgcttatttaccattccaaaaatcctggggcctttaaaaactatgctaaatctactctgcctgtgctctataaatggaaggacagaacttggatgacagcacatctgtttacagtatggtttactgactattttaagcccactgttgagactttctgctcagaaaccagagagattcctttcaaaatattactgctcattaacaatgcatctagtcacccgagagctctgatggaaatgtacaaggatattaatgttgttttcatgcctgtcaacacgtccattctgctgcctatgaatcaaggaaaattaccacagccactccaaccttcagcaagtaccaccctgatcagtcagcagccatccacatggaggcaagaccctacaccagcaaaaaaattaccactagatgaagcctcagatgatcattagcattttctagcaataaagtatttttaaattaaggtattccctgttgtctcattggcggctttctgagcagctgcaaaatatgtttttaacttttaagtggaagttgggggtcactggcatcgagtctggaacagtcattctcagcaagagctctttgaactctgacattctctagttttacggactcggaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttaaattagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcggtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttaaataacatatggtatttggcaaatagatttatttttcaaaatgtctcactagtttccttttacacaatgtatatacttcaagatgtatagaaaggaaagctacagttgagcccttatacatgttttaaggtagaaatatgttccctattgtttgaaaactgattgtaagaataacctcagttaggagatataacttgaagtgtcagtccaaactactgatttaaccctatttacggtaacacattaccttcctcacctcctgtttggccctggagaatgtagtcctttttctcatttgtgttgagaaatgaaaagtctgctgtagaatgtatctgatgtcattagttcttcaaatggataccattgtacatataacagtagaatttggtttggggttgttagtgaaaaaaaatttaaacctgccattaaaaatccccatgtttcatggaaatctaacagaaatacattgtaataattagaacattttgttttcttttttcttttttttttttcgagacggagttttgcccttcttgcccaggctggagtgcaagggcgcaatctcggctcgctgcaacctccgcctcccgggttcaagcagttctcctgcctcagccccctgagtacctcagatgacaggtgcgtgccaccacacccggctaatttttgtatttttagtagagacggggtttcaccatgttagccaggctagtctcgaactcctgacctcaggtgatccacccgcctccgcctcccaaagtgctgggattacaggtatcagccaccgtgcctggcctaataattggaacattttcatcatgaaaatgtcatcagctttgccaaaagaaacaaccaattgacttgtttggcgtttgttttccattttcatgtcaattttatgtatacagttagaatacccaaggagaccactaaaatcagttaaacaagtagggtatatacaaagaaagatgaaacccgaaagtacataaaaaggatttaaatccgattttagatgtacctagtgtgtatttcttatctctagacaagttcatgtttattgtttaatttatgcccaagtgaagttgtaaacttatggttcaactctgacacagaatttgtcacttgtctgaggtcagtggcaggtttctctgctgtcaagcactctgtgtcacccaccagattagtataactattaattcagactgtactcctatgtttaagataatttttacaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgcta

SEQ ID NO: 466580 - DNA, 663 bp, Homo sapiens
gagcggccgctcgcgatctaggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgcta

SEQ ID NO: 466581 - DNA, 2754 bp, Homo sapiens
  misc_feature (2711)..(2711): n is a, c, g, or t
  misc_feature (2721)..(2721): n is a, c, g, or t
gagcgcggccgccgagcccagctccgccgccgagcgcctgtgccggcacggctacaccatggagcgcccggataaggcggcgctgaacgcactgcagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttaaattagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcggtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttactgtcnaatgttggantattgttttgactactcctgagatcctgtagag

SEQ ID NO: 466582 - DNA, 896 bp, Homo sapiens
ttgatgttcactcttcccctcactcatgagaggccttctgccatcttggtccccagacccggccttgccactcagtgtccctaccactcgagaccctggctccaaaacgccactcatcccacagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcaaaaaaaaaaaaaaaaaactcagacgcctcggtggccgagaattacgggcactgaaggcgcgcgagacgggatggggctggctgcggctggggcggagccggcgggggcaacgcgggaagggcgcgccggcgaacctccgggtccccggcccggatccccggtccccagatggctccttaaggcccctggccggcgtccccgggcaggagcggggctatggcggccacccggggcgcctgggccggggaccgtggtggtgcccgtcgacggatagaaggacggttgggagacaccgcgagggggacccgcaagggcccgggaagccccgggggggagaaaaaagcgggagcgcgcgggataaaacggaaagcctgaagggagcctggagcatcgttagtaggg

SEQ ID NO: 466583 - DNA, 4701 bp, Homo sapiens
ttgatgttcactcttcccctcactcatgagaggccttctgccatcttggtccccagacccggccttgccactcagtgtccctaccactcgagaccctggctccaaaacgccactcatcccacagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttaaattagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcggtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttaaataacatatggtatttggcaaatagatttatttttcaaaatgtctcactagtttccttttacacaatgtatatacttcaagatgtatagaaaggaaagctacagttgagcccttatacatgttttaaggtagaaatatgttccctattgtttgaaaactgattgtaagaataacctcagttaggagatataacttgaagtgtcagtccaaactactgatttaaccctatttacggtaacacattaccttcctcacctcctgtttggccctggagaatgtagtcctttttctcatttgtgttgagaaatgaaaagtctgctgtagaatgtatctgatgtcattagttcttcaaatggataccattgtacatataacagtagaatttggtttggggttgttagtgaaaaaaaatttaaacctgccattaaaaatccccatgtttcatggaaatctaacagaaatacattgtaataattagaacattttgttttcttttttcttttttttttttcgagacggagttttgcccttcttgcccaggctggagtgcaagggcgcaatctcggctcgctgcaacctccgcctcccgggttcaagcagttctcctgcctcagccccctgagtacctcagatgacaggtgcgtgccaccacacccggctaatttttgtatttttagtagagacggggtttcaccatgttagccaggctagtctcgaactcctgacctcaggtgatccacccgcctccgcctcccaaagtgctgggattacaggtatcagccaccgtgcctggcctaataattggaacattttcatcatgaaaatgtcatcagctttgccaaaagaaacaaccaattgacttgtttggcgtttgttttccattttcatgtcaattttatgtatacagttagaatacccaaggagaccactaaaatcagttaaacaagtagggtatatacaaagaaagatgaaacccgaaagtacataaaaaggatttaaatccgattttagatgtacctagtgtgtatttcttatctctagacaagttcatgtttattgtttaatttatgcccaagtgaagttgtaaacttatggttcaactctgacacagaatttgtcacttgtctgaggtcagtggcaggtttctctgctgtcaagcactctgtgtcacccaccagattagtataactattaattcagactgtactcctatgtttaagataatttttacaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgcta

SEQ ID NO: 466584 - DNA, 1825 bp, Homo sapiens
gagcgcggccgccgagcccagctccgccgccgagcgcctgtgccggcacggctacaccatggagcgcccggataaggcggcgctgaacgcactgcagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttaaattagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtgagccaagatcgcatcattgcatttcagcctggacaacaagagcgaaactccatcaaataaataatatctaatagccaga

SEQ ID NO: 466585 - DNA, 561 bp, Homo sapiens
taggtagaaagatgtttatttgtgggaactgtcttttgtttgtagaattactcacctctccactgacattgaaagacagccatattgtttttagtgggattttaggagctgtgagcagaccactgggacaattcagtatggcaaaggtgaccagtgagccacagaagcctaatgaagatgtggacgaacagaccccatcaacctcaagtaccaaagggaggaagaaggggaagacaccccgtcaacgaaggtccagaagcggcgttaagggcctaaagaccaccaggaaggcgaaaagaccccttcgagggagctcgagccaaaaagccggtgaaactaacacccctgcaggaaaacctaagaaagctagaggaccaatactgcgtggtcgttatcaccggctgaaagaaaaaatgaagaaagaagaggccgacaaagagcaaagcgagacctcagttctgtgatgtctctagaggtccgccactgaaaagtcatcaatcatacagtcagtgaattctacaccaacaggttaaaaccatgaaaataaaatcaacctgaatc

SEQ ID NO: 466586 - DNA, 1646 bp, Homo sapiens
gtggaccggacgctgctgcgcctcctctctcaggccgcggttctatgctgccctgtgcccgcgccaaacgccctgatctctctctgtctcctctctcaatctctctttgcctttcctcctttccagatgcgaaggctgtagggactttggtgactgaagctggaggagacgaggagaagaaaatacggtccaaacccgagcagggagctggagcagaagaagaaagtcacttctgtgcgggagctgccgaccccacgatcaaggataaccagaagcgcggcggtggcgaccaggagccctcgcagcagcagcctgaggcttccagcccaggactcctccgcggaggagccacaaccccaatattagcggcgtctcttcagccccagtgcgttcagcaggttgcacctgaaggagctagacagcattttcccacgctctgaatatctcgacgtgttcgctcgaaagcagcttgcaatctgcatggatgtgagtgaagccgaagtggaagccagtaagcctgatgaaagcaattggtcagagtagccactctctgaaacctgcctcagtccttgaatacctttgtcctacacattctccaattggcctgtttttgttgccttttctatgtttgccaagtgagttttgaactttagcgggggaataatgggatacataaaccttagcctatggaaatttcccattaccagagggaatatgctttctaatgcgaaacagaactaaactgttacttctatttcctgtacaaggttaagtgtaaataaagttccattccttctaacaatggtatcctttagagaacacttctgtgtggagttatgttgggactgagtctgacttgaggagtttgcaaattaatgcaccaaggacccatattgtgagaaggttcaactgtatttaaaatatttaaaccaggctatgttcttagctaaatgaccaaatttataaatattcaggcattgggataagggaataagttacatacagaaagaacacattatatgagtaattaatgtatgtttagtttcactgagacttatggggaggacatagcttaaaagtccaagtgcctggtagtcctgctgttgtttttaagggtctgatgaagccatgtagaaagtggcagcccgcaattttgattttctccaatacttttatttgtaagccggaatacactgctaatatacttgcattacactgggggtgtgggggggcaggtttgcaaacaggaaatttgtttaaaaattggaataaaaaagaacaattttgaaaaagttttcacttaactaagaagggtgaaaaggttaaagaaaaattgcatacactcaaatatataccttgaaggtatggcacaaatggagctctatgagggaatattctctttaggaatttctgacaactaagaagttttttttatgttactgttttaaactggtgggttttatgtaatttgtttggtggtggggtggggcacgctcaatttagaccaggttcttacctgtgctaatttgaaatggtttttcattttcccaggcagtggtgattaatttgtaagtcatgagatcaagaaattactaagattacttcagtattattgactgagtatattttcaaaacaaagagaaaat

SEQ ID NO: 466587 - DNA, 924 bp, Homo sapiens
ctctgtgtggcatatggagattctgtcaaaactgcgctctactcatgctagcaatgactacgtggaacggcctccagccccctgtaaacaggccctctccagcccttcccttattgtgcaaacccacaagtctgattggtctctggctaccatgcctacttctctcccccgcagtctcagccagtgccatcaactgcagcccttgcctcagcatctgagccaatctagcattgccagctcaatgtcccatagcaccactgcctcttgatcaaaggctcttggccagcattacaccctcaccttcaggccaatccatcatccgaacccaacctggagcaggggtccacccaaaggctgatggtgctctgaagggagaagctgagcaatctgcagggcaccctagtgagcacctcttcatctgtgaggaatgtgggcgctgcaagtgcgtcccctgcacagcagctcgccctctcccctcctgctggctgtgcaaccagcgctgcctttgctctgctgagagcctcctcgattatggcacttgtctctgctgtgtcaagggcctcttctaccactgctccactgatgatgaagacaactgtgctgatgagccctgctcttgtgggcctagttcttgctttgtccgctgggcagccatgagcctcatctccctcttcctaccctgcctgtgctgctacctgcctacccgtggatgcctccatctgtgccaacagggctatgatagcctccggcgaccaggctgccgctgcaagaggcacaccaacactgtgtgcagaaagatctcttctggccgcacactgagttaacagcagaattgagactggaatataggccttctgactcctagttcagtattcttacccctgtaccacattgagtcatgggactttttcctagggctctatt

SEQ ID NO: 466588 - DNA, 3237 bp, Homo sapiens
gtaaatctactaaacttatttatacaagagaatgtctctggaaatacacaagtggtgagagaaggggaggggaggagaaggcctctgaggtaaactgtgaagggaagttgactgtgggtaaggggcagagaggcattcattgaactgctatttcttgaggtcactctgggcgaagggcagtgcctggggtcctacttgccggcccaggcacaggcacggagtcagaacatcctgccccgccccttccccccaacctttcaccttcctttccagccccaccccgctcccatggccccggaccttggcaacgctgcgcagcgcgtcagtcaacgtcacagggcgtgggggtggctagaggccccagtggcctctgatctcacagagcagatcagcgcgggtgtccagcgccccgatgtgggcagtcggggctagccgctggggcaggctgcccccagcaagaggagcggccgctccaaaccacaaaatctccaacgccggacagcgcggcctcggtcaccatacgctacaggcatcctgcaggccatcgcgtgtggtggagcgtccggcgcttatcgtggtcagtccccctctacgccaccgtccgattcccccgacgcccccgccgaccccggagcttgccctcagccccttcatctgccgaggcatacccttgctgcccatcccacccagggatcgccacctctgccctctaccaggctccgggcccggtgccgaggactggccgccaagggttgcggactatggccctaaagctcatccacaaggagttcctcgaactggcccgcgacccccagccccactgctcagcagggccagtgtgggacgatatgctccactggcaggccaccataacgaggcccaacgacagctcctacctgggaggggtcttcttcctaaagtttccctccgactacctattcaaaccacccaagatcaaatttaccaacggaatttaccatcaacgttaacggaaatacgcgacaggagggagtatggcagaatagctaaagactggactcagtagtgtaccatgtaatttcaaaatataattccatcgccttaataataaagatgcagaaagcagcttaggcctgccctgtggagcatcgctgcaggggccagcttgagcaacacggatcctgagagtgctcccaggtaggcaattgccccggtggaacgcctcgccacagcagcgcgtggcaggcccccgtggaggatcaacgcagtggctgaacaccgggaaggaactggcacttggagtccagacatctgaaacttggaactatgttgaaaaatttcaagaaaggatttaagggagattatgatgttactatgacaccaggaaaatttagaactttgtgtgaaatagactggccggcattagaggtgggttggccatcagaaggaaggctggacaggtcccttgtttcaaaggtatggcacaaggtaacccataagccagggtacccagaccagttcccatacatagacacttggttacagctagttttagaacccccacacacacagtggttgagagaacagcagcatcagcggctggcagaggcaaagaaagaccagcagagagacagagagaggaaagagacagagagaaaaggaggcaaagacagagaggaaaagacagagaggaagagacagagagacaaagagggagtcaagaagagagagagagagaggcagagagagaggaagagacagaggcaaaaggaaagtcagagagagacagaaagtcaaagagagaaagaaagagagaaatatacaagtagttaagaaaaaaaacagtgtaccctattcctttaaaagccaaggtaaatttaaaacctataattgataattagaggtattctccataaccctgtaacactctaataccactttgttgtcagtgtaaacaagggcatatccgaaagcactgagaccttcctatcaaaaatctttaacccagtaacctgcggatggcccagatgcattcaatctgtagcgccaacagctttgctaacagaagaaagtaaaaaaaataacttttagaggaaacctcattgtgagcacacctcaccagttcagaagtatcctaaaaaagaaaagaaaagaaaagaaaaggatgatttaacattaaccactgaaaattcttttaacccagcagttttcctaacaggggatctaaatcttaattaccatacaaaggtccgaccagacctaggaggaactcacttcaggacaggatgatctatggttcctcccgggtaattgaagggggaaaaaaagccatctataccaattctaagttaatttggactaaacaagttcttattaatagcaaaggataattgaaatcccaaacttacaagttttcaacaaaagtaaagtttgctaaaagttaacagtgtaacaagtattatagtaacttctaatcttgtggccttagacagcctagtccacagacataaaggaagttcgctttggaaaagaatggttatcatcttcgaaaaaaaaagagggggaagagggggtagaatttatgtaaaaagagtgttatatggtaaattcttgtcctgaaataaattaactggttgtttaaagaaagaaatgtttgtaataagtcagaaagttaaggtatgtcgaagaattgtctgcgaaagtcgtgaaagagaaaaaagttataaaaaaagtatgcaagaaatgttgtataatttaaaagtaataaggcctcctgagtaatattgaagaaacagtttatgtgcaaagtgtataaggaaagtaaaatatacctttggtaaaaggattataaggaggcataagaatgtggatttttatctacattaaaaggttaaaaaatattgttttgaaggtttaagcaagttttaaaatgttaattataaaggaaattctgtgtgtaaacatattagctaaagttaaagcagtatcatccagtttttctgtgaactggacatgaaagtaaaaacacaacaggtttttcttaaagcactaacctgctctttaaaaaagattataaaaggttaaaaagagtctataaaaatcttaccttatggtccaacattaaaaattgaataaatatgtatacaaatttttttaaaactaagtttaacattaatagcacagtaatataaaggtaaaatttagcttatctggtataaaaatcatacaagaagcattgtcaaatataaaatggtgttt

SEQ ID NO: 466589 - DNA, 3124 bp, Homo sapiens
gtaaatctactaaacttatttatacaagagaatgtctctggaaatacacaagtggtgagagaaggggaggggaggagaaggcctctgaggtaaactgtgaagggaagttgactgtgggtaaggggcagagaggcattcattgaactgctatttcttgaggtcactctgggcgaagggcagtgcctggggtcctacttgccggcccaggcacaggcacggagtcagaacatcctgccccgccccttccccccaacctttcaccttcctttccagccccaccccgctcccatggccccggaccttggcaacgctgcgcagcgcgtcagtcaacgtcacagggcgtgggggtggctagaggccccagtggcctctgatctcacagagcagatcagcgcgggtgtccagcgccccgatgtgggcagtcggggctagccgctggggcaggctgcccccagcaagaggagcggccgctccaaaccacaaaatctccaacgccggacagcgcggcctcggtcaccatacgctacaggcatcctgcaggccatcgcgtgtggtggagcgtccggcgcttatcgtgggatcgccacctctgccctctaccaggctccgggcccggtgccgaggactggccgccaagggttgcggactatggccctaaagctcatccacaaggagttcctcgaactggcccgcgacccccagccccactgctcagcagggccagtgtgggacgatatgctccactggcaggccaccataacgaggcccaacgacagctcctacctgggaggggtcttcttcctaaagtttccctccgactacctattcaaaccacccaagatcaaatttaccaacggaatttaccatcaacgttaacggaaatacgcgacaggagggagtatggcagaatagctaaagactggactcagtagtgtaccatgtaatttcaaaatataattccatcgccttaataataaagatgcagaaagcagcttaggcctgccctgtggagcatcgctgcaggggccagcttgagcaacacggatcctgagagtgctcccaggtaggcaattgccccggtggaacgcctcgccacagcagcgcgtggcaggcccccgtggaggatcaacgcagtggctgaacaccgggaaggaactggcacttggagtccagacatctgaaacttggaactatgttgaaaaatttcaagaaaggatttaagggagattatgatgttactatgacaccaggaaaatttagaactttgtgtgaaatagactggccggcattagaggtgggttggccatcagaaggaaggctggacaggtcccttgtttcaaaggtatggcacaaggtaacccataagccagggtacccagaccagttcccatacatagacacttggttacagctagttttagaacccccacacacacagtggttgagagaacagcagcatcagcggctggcagaggcaaagaaagaccagcagagagacagagagaggaaagagacagagagaaaaggaggcaaagacagagaggaaaagacagagaggaagagacagagagacaaagagggagtcaagaagagagagagagagaggcagagagagaggaagagacagaggcaaaaggaaagtcagagagagacagaaagtcaaagagagaaagaaagagagaaatatacaagtagttaagaaaaaaaacagtgtaccctattcctttaaaagccaaggtaaatttaaaacctataattgataattagaggtattctccataaccctgtaacactctaataccactttgttgtcagtgtaaacaagggcatatccgaaagcactgagaccttcctatcaaaaatctttaacccagtaacctgcggatggcccagatgcattcaatctgtagcgccaacagctttgctaacagaagaaagtaaaaaaaataacttttagaggaaacctcattgtgagcacacctcaccagttcagaagtatcctaaaaaagaaaagaaaagaaaagaaaaggatgatttaacattaaccactgaaaattcttttaacccagcagttttcctaacaggggatctaaatcttaattaccatacaaaggtccgaccagacctaggaggaactcacttcaggacaggatgatctatggttcctcccgggtaattgaagggggaaaaaaagccatctataccaattctaagttaatttggactaaacaagttcttattaatagcaaaggataattgaaatcccaaacttacaagttttcaacaaaagtaaagtttgctaaaagttaacagtgtaacaagtattatagtaacttctaatcttgtggccttagacagcctagtccacagacataaaggaagttcgctttggaaaagaatggttatcatcttcgaaaaaaaaagagggggaagagggggtagaatttatgtaaaaagagtgttatatggtaaattcttgtcctgaaataaattaactggttgtttaaagaaagaaatgtttgtaataagtcagaaagttaaggtatgtcgaagaattgtctgcgaaagtcgtgaaagagaaaaaagttataaaaaaagtatgcaagaaatgttgtataatttaaaagtaataaggcctcctgagtaatattgaagaaacagtttatgtgcaaagtgtataaggaaagtaaaatatacctttggtaaaaggattataaggaggcataagaatgtggatttttatctacattaaaaggttaaaaaatattgttttgaaggtttaagcaagttttaaaatgttaattataaaggaaattctgtgtgtaaacatattagctaaagttaaagcagtatcatccagtttttctgtgaactggacatgaaagtaaaaacacaacaggtttttcttaaagcactaacctgctctttaaaaaagattataaaaggttaaaaagagtctataaaaatcttaccttatggtccaacattaaaaattgaataaatatgtatacaaatttttttaaaactaagtttaacattaatagcacagtaatataaaggtaaaatttagcttatctggtataaaaatcatacaagaagcattgtcaaatataaaatggtgttt

SEQ ID NO: 466590 - DNA, 3098 bp, Homo sapiens
gtaaatctactaaacttatttatacaagagaatgtctctggaaatacacaagtggtgagagaaggggaggggaggagaaggcctctgaggtaaactgtgaagggaagttgactgtgggtaaggggcagagaggcattcattgaactgctatttcttgaggtcactctgggcgaagggcagtgcctggggtcctacttgccggcccaggcacaggcacggagtcagaacatcctgccccgccccttccccccaacctttcaccttcctttccagccccaccccgctcccatggccccggaccttggcaacgctgcgcagcgcgtcagtcaacgtcacagggcgtgggggtggctagaggccccagtggcctctgatctcacagagcagatcagcgcgggtgtccagcgccccgatgtgggcagtcggggctagccgctggggcaggctgcccccagcaagaggagcggccgctccaaaccacaaaatctccaacgccggacagcgcggcctcggtcaccatacgctacaggcatcctgcaggccatcgcgtgtggtggagcgtccggcgcttatcgtggctccgggcccggtgccgaggactggccgccaagggttgcggactatggccctaaagctcatccacaaggagttcctcgaactggcccgcgacccccagccccactgctcagcagggccagtgtgggacgatatgctccactggcaggccaccataacgaggcccaacgacagctcctacctgggaggggtcttcttcctaaagtttccctccgactacctattcaaaccacccaagatcaaatttaccaacggaatttaccatcaacgttaacggaaatacgcgacaggagggagtatggcagaatagctaaagactggactcagtagtgtaccatgtaatttcaaaatataattccatcgccttaataataaagatgcagaaagcagcttaggcctgccctgtggagcatcgctgcaggggccagcttgagcaacacggatcctgagagtgctcccaggtaggcaattgccccggtggaacgcctcgccacagcagcgcgtggcaggcccccgtggaggatcaacgcagtggctgaacaccgggaaggaactggcacttggagtccagacatctgaaacttggaactatgttgaaaaatttcaagaaaggatttaagggagattatgatgttactatgacaccaggaaaatttagaactttgtgtgaaatagactggccggcattagaggtgggttggccatcagaaggaaggctggacaggtcccttgtttcaaaggtatggcacaaggtaacccataagccagggtacccagaccagttcccatacatagacacttggttacagctagttttagaacccccacacacacagtggttgagagaacagcagcatcagcggctggcagaggcaaagaaagaccagcagagagacagagagaggaaagagacagagagaaaaggaggcaaagacagagaggaaaagacagagaggaagagacagagagacaaagagggagtcaagaagagagagagagagaggcagagagagaggaagagacagaggcaaaaggaaagtcagagagagacagaaagtcaaagagagaaagaaagagagaaatatacaagtagttaagaaaaaaaacagtgtaccctattcctttaaaagccaaggtaaatttaaaacctataattgataattagaggtattctccataaccctgtaacactctaataccactttgttgtcagtgtaaacaagggcatatccgaaagcactgagaccttcctatcaaaaatctttaacccagtaacctgcggatggcccagatgcattcaatctgtagcgccaacagctttgctaacagaagaaagtaaaaaaaataacttttagaggaaacctcattgtgagcacacctcaccagttcagaagtatcctaaaaaagaaaagaaaagaaaagaaaaggatgatttaacattaaccactgaaaattcttttaacccagcagttttcctaacaggggatctaaatcttaattaccatacaaaggtccgaccagacctaggaggaactcacttcaggacaggatgatctatggttcctcccgggtaattgaagggggaaaaaaagccatctataccaattctaagttaatttggactaaacaagttcttattaatagcaaaggataattgaaatcccaaacttacaagttttcaacaaaagtaaagtttgctaaaagttaacagtgtaacaagtattatagtaacttctaatcttgtggccttagacagcctagtccacagacataaaggaagttcgctttggaaaagaatggttatcatcttcgaaaaaaaaagagggggaagagggggtagaatttatgtaaaaagagtgttatatggtaaattcttgtcctgaaataaattaactggttgtttaaagaaagaaatgtttgtaataagtcagaaagttaaggtatgtcgaagaattgtctgcgaaagtcgtgaaagagaaaaaagttataaaaaaagtatgcaagaaatgttgtataatttaaaagtaataaggcctcctgagtaatattgaagaaacagtttatgtgcaaagtgtataaggaaagtaaaatatacctttggtaaaaggattataaggaggcataagaatgtggatttttatctacattaaaaggttaaaaaatattgttttgaaggtttaagcaagttttaaaatgttaattataaaggaaattctgtgtgtaaacatattagctaaagttaaagcagtatcatccagtttttctgtgaactggacatgaaagtaaaaacacaacaggtttttcttaaagcactaacctgctctttaaaaaagattataaaaggttaaaaagagtctataaaaatcttaccttatggtccaacattaaaaattgaataaatatgtatacaaatttttttaaaactaagtttaacattaatagcacagtaatataaaggtaaaatttagcttatctggtataaaaatcatacaagaagcattgtcaaatataaaatggtgttt

SEQ ID NO: 466591 - DNA, 2014 bp, Homo sapiens
gaaaatctttcatttcttaaaagacactatgggcacagctgcccagaccctgctcctggacagctggttaagtattcagatttctcaggcggtgggcagggccatagaactcccaagagattatgaccttggtctttgtctaccagggtgtgtagagaaagaccacccggtaggggcagggataggcatggctgagctcagcctctccttgggtgtggcttgctgtgactgctgtgggggatgggggtgtggtgtctggtccaatggagttatattcccagggggattatggctgcttctgctgaaccatacagtttgccagcaagtgggggaaagtcagcggtcatgggcctcaccctgctcccatgcagcctgcagccctaaaggctggtgtcattcccactgtgccctacaacagcaccgagtctatttcagggcaaccagtgaccagggctgagaacttgtcccagaccaccagcttccccactgacaaagcaagcagactcacagtttttcggcatctcagggggcctgcaacagtgatccagtttcttcaaagggtctgtggattctctcagctttcctggtatgttcctgcagtacttcttggagcaaaggtttacagtacgagtctccacatgctgctctgtccatctcagcaggagctgcaagctggtcctgcctcctatctgccatcttgcccccatgcatttatctgaaatcaaaatacttttaataaaagcattatactactaatattccagtgtgaaagttcctttctgctcatattagaaataatgtgaatctttactaatctgataggcaaaaaaaatcatctctcatcattgtttcaatataactcatttttgctctcttctgaaatttcatactgtggatgtgacataatcaattttcacaaccccatattattcagagtgttccaatattccctattatctacacgacatggatagcatcttttcagagtctgtgcactggtagtggttgtaatccagggcagagttcccatggctatttgctctggtgagctgaatgggtccccttggagcccaacaactatgttgagagaattgtagtattgtgataacagaacctggttgatgtaggagtgagtgtgtgtgtgtgagagagagagtgtgagtgtatgtgtgtgctgacaaccacatttccctttacttccttctggcttgtgtctttgcatctcatttcgtctccctttctaaattcaagcccaaaagtgaaaaaagggaaatatcaggatggcagtacttgtaaccagattttaatcaacattcttcactaagtcctgaagataaacatataaaaggaaatgctagcacaaagcgtgtgtgcctatgtaggccttgataagtattgctctacagacactcataaagtagtgccatttagactccccaagtatagggaggtgagaaaggctacagaggaatgaagaaagtactgacgctgacaaggtgttgcagaggaaaggccctggactctgtggtggacacacatattggtcatttgtctattttcggttttgttgtctgtgcttttaaggtcttagccataaaatatttgcctagaccaatgtactaaagtgtttcccccaggtttttgtctagtacttttatagtttcagatcttacatttaagtctttaattgatcttgagttgatgtctgtatatgatgagagacagagatgcagtttcattcttctgcatatgcatatccaattttcccaataccatttattgaggaggatgtcctttctccaacgtacgttcttggtgcctttgttgaaaatcagttttgtctgtaaacatgtggatttatttctgcgttctctattctgttccattggtctttgtgtctgttttcataccaataccatgctgttttgattaccatagccttgtaatatattttgaagtcaagtagtgtgatgcctccagctttgttctttttggtctggattggtttggttat

SEQ ID NO: 466592 - DNA, 871 bp, Homo sapiens
tgcagtacgggggttcgtcgtaggtgaccagcatgtacctgtctccacggctggccgggtcccgggcgcgcagctgcggggcaagggatgacggagggggtcgccgcctttggcaatgtccaaataagaggtgcccaggtcagtgcgctggttcatagaggcggacgtgtctatgaggaacagcaggatgggcatcttcccccgcactcctgcctccgctccccactctcccggccctcttgccctcactgccgcgtacggccacctgaaccctcaactctcgcagagccggggagcaaggagcaagaggaagagggggagacgggacgggacgggacggatgggaccgctcctggcctcctctttctgcagccccacctcctctccctccaagggaacttgaaagtcatccgtccgcgctcactagagcgctcgccccagactgagcgccgtctctgttcactgacaacttctgtctgctcacctaccatcggcaccatgtgaccagaacccatgccattggctgccaattatgtgatggtgattcgaaaagaagagtgaatttgagcaacagttgtacagaagtacagaagcagatgcttggacagtttgcacagaaaattcttcgctaactgcaatcgatcaatcctgccagtggcgaagacgaaaatatttcagaagcagcaaacttctttcctggcaggacgtactcacattcctttagatccctcccccgtcttgatcagtatttgtgagttggttgctggccttgcattccacatatatctacttagaaaggaaactaaagcttaaacacagttacagttacctaaactggccttttgtatgcacaagcttcttcagtttcact

SEQ ID NO: 466593 - DNA, 1473 bp, Homo sapiens
ttcaagtcacctgggatggcaagtgctgccaggagcgcgccggtgcgagtcgccgcagcctgcagccagctgctgttgccgccgccgctcggtcgtgggctagcgcgcagggtgcggggtgcgggcgggcaggcggcgtgtggtggggggcggggggtgttggcgtctgtcgtccgggcagctgggaaggcttctgtctctttggttccccctgtggctgctgcggggctgcggggctgcggggctgcggggctgcggggctgcggggctgcggggctgcggggctgcggggctgcggggctgccgggctgcgggcggtgggagatgacgggggtgggagcaggagcgggagcaggggcgggagcgggagcgggagtgggagtgctcagtctctcgggtcgcctggatatttatgaaaaggacgccagggaaagggctccgctgtagaccgaagggataagggttcgattcagaagggagcgttatttttatcccctctccacataatggaacgtttaaatggttaaatcaagtaccttgcaggagagggtggggtggccttgagaatacactcaaggcctcagtacatgcagtctggaagtgggggaatcaagagcaccctgtctctagtactgtcctcaatgataaggcgctgaggttcccaacctggaccaagaagtacatattcaggttcaaaggataaaccaaaacaaaacctgagctctctctctagaatgaagtgcctggtcccagttcaccatctaatatttatggaaagcttatcagagaacagaagtgtcagcagaggactgtaagtgctatgtgattggacgacggtggccatagaatttcacctgcccagcacgtattctctcatcctctcctcctctgccttctttgggagggagaaatcagaaggagtggggatgcagttcagagagcagaggagaagagaagaaaagaaggaagaaggaagaggactagggttgggtggggggggaggacaccaatgggaagagggacagatcaactctatacacaaaagtaaatcaaaacaccaaaaacaggggtctatgtaaagaagcctcttcccgtgaattgctcgttgcatagctgcagggagggtgtttaggggcatagagaatgaaaacatacctgtattttggtgtagggaaattgtttctgtcaattcacaccgtccacacaccacctcccaccccaaccccgccactaccaaattcctctaaataaaaataattatgagatacaggccaacaaaaacgtcagcgttaggctgttatttagagagaattggaaagcgtttgaatgtggccctgttgtttaataaacgataacaatgattaaaaaacaaaccgaaccctctttgaccatgtcaaaagggagctcaaacaagtcttaagatgtagcaattttacatgtatgccgatttgctatatgcatttttctgctctg

SEQ ID NO: 466594 - DNA, 1456 bp, Homo sapiens
ttcaagtcacctgggatggcaagtgctgccaggagcgcgccggtgcgagtcgccgcagcctgcagccagctgctgttgccgccgccgctcggtcgtgggctagcgcgcagggtgcggggtgcgggcgggcaggcggcgtgtggtggggggcggggggtgttggcgtctgtcgtccgggcagctgggaaggcttctgtctctttggttccccctgtggctgctgcggggctgcggggctgcggggctgcggggctgcggggctgcggggctgcggggctgcggggctgcggggctgcggggctgccgggctgcgggcggtgggagatgacgggggtgggagcaggagcgggagcaggggcgggagcgggagcgggagtgggagtgctcagtctctcgggtcgcctggatatttatgaaaaggacgccagggaaagggctccgctgtagaccgaagggataagggttcgattcagaagggagcgttatttttatcccctctccacataatggaacgtttaaatggttaaatcaagtaccttgcaggagagggtggggtggccttgagaatacactcaaggcctcagtacatgcagtctggaagtgggggaatcaagagcaccctgtctctagtactgtcctcaatgataaggcgctgaggttcccaacctggaccaagaagtacatattcaggttcaaaggataaaccaaaacaaaacctgagctctctctctagaatgaagtgcctggtcccagttcaccatctaatatttatggaaagcttatcagagaacagaagtgtcagcagaggactgtaagtgctatgtgattggacgacggtggccatagaatttcacctgcccagcacgtattctctcatcctctcctcctctgccttctttgggagggagaaatcagaaggagtggggatgcagttcagagagcagaggagaagagaagaaaagaaggaagaaggaagaggactagggttgggtggggggggaggacaccaatgggaagagggacagatcaactctatacacaaaagtaaatcaaaacaccaaaaacaggggtctatgtaaagaagcctcttcccgtgaattgctcgttgcatagctgcagggagggtgtttaggggcatagagaatgaaaacatacctgtattttggtgtagggaaattgtttctgtcaattcacaccgtccacacaccacctcccaccccaaccccgccactaccaaattcctctaaataaaaataattatgagatacaggccaacaaaaacgtcagcgttaggctgttatttagagagaattggaaagcgtttgaatgtggccctgttgtttaataaacgataacaatgattactaagttgtcctgagtcaatacaacaaatttagcaaatggtcctttgggtccttataaagtgaagagttgacggagacagatttgtatatgg

SEQ ID NO: 466595 - DNA, 692 bp, Homo sapiens
cggcagcgggttcagtcaccaggacacacaattataacatcaagatgccgaagactgaggaaactgtgctccagaatgatcccagtgtagcagagaatggggcccctgagcctaaaacaccagggcagagccagaaaagcaagagtttctgtttagatgaccagtctcctgatctgatagagacagttaatgaagtttccaagctgagcatttcacatgaaattgtagtaaaccaagatttctatgtggaagagaccattttgcctccaaacaggttgaacatcccaaatcggaaatccacgatgctccaaaatccaaaacattttgagcgccaacatgatgctcaaaggaaatgctcattgcggtatacaagtatgctgcaaatattccaaaatccaagaaatcctgtagaaggcaggtttgcggaggcaatgtacaatgctttttggaaccatctgaaagaacagctattgagtactcctcctgacttcacttgtgcccttgaacttctaaaagatgttaaggagaatcccggagatgaataggcgagcccttgcccacaaggaacttgcatgcttgagtcaaaaggctatttcaagggaaccttaaagattccagatttgctattttatcctcacactttggagtaaaacaatctaaaaatatccttatcctttattaagaatgcctca

SEQ ID NO: 466596 - DNA, 1989 bp, Homo sapiens
gcaaagcgccgacagtcccccgagcgaggacggcagcgagactccgaagcccccttagcaaccaagccggtgccgctgcccttgcgccgggactgcagccgggtcttccgaagtgaggatatgctgccctctagaggccgcggggtgacatggcccatgaggctgtctgggcagggcagctcgtgcccccaggcaggattccaacagtgcagaagcccccagtccccaagtccggggtggcaaggacttccagcctccccggggagccaccttggccctccctccctcctgctggctgggtgccgcgctgcggggctgctcaggttccctgctgagtcccccgctgggctgtgatcgttgcggatttaaacaccacactgtggaagcggagatggccccgcgtgcaccgctgaagtgaaggggctcgtggcaaatgatgcggggggacagcggccagagcagaccccggcggggtggcccgcccgggaggtggctgagggtccccggctgcggggtgaggggcgggaccgggaggcacaccctccgtgatcgccaccagaggccgcctggaacccgagtttcaacctcccggggatcctgtcccgcttcccagcgatgtttgccatgactgctgcgagttctccgacctcgaggccactctcctttccttccaaggacgcccagaacccgcggagggaggagggggtgagggaggagggagagaggaggcaggagggagggaggaaggtggcggggagaagaagagagggagggaggaaaaggaaggaactgcgttggcctgtcgcctccgcactgtaagattctggcacccagggtcccggccccctctcctggggccaaacgttccggttcccgatgccaggctgcagaaaaaatgagcacactgaacacgtggactagcacataaataaggttattacctcctttttattttttgcacactaattaataaactactgcaacggaaaaagagaaagcaggcagaatgcaaacagcctctcggtggctctgttatgtaggagggaggtatggaggctgcttggtggtcaaagaattcctccaatgcccgctccaaagcggagccctgcaacggccttaaatcaaaaggaaagcgggtgtcagcagcaagcacagaaagtggggcctagttcagccaggagctaacacaatattcctgctggggtggggatgggggcacgactattacaaaactagggccccctgaaagcgccctgccccacccaacacacacattcacttccttgtaggtttgcgctgcaggcagcttccgttgaaccatacccggacctccacccaccatgaccagagctgctggggctgggagcaggcacctgccccaagcactgggccaccagcgtccccttgcccaggaatttaggattggggatggccacgaccctgtggcctgacactcatggcacggttctgagggctgctcccctctgccctggcagcgtgattccatctgccgtgacgagagtccagcggcgctctgcattgaagcaaagccatggagccctgttgcaggagcacctgcaaacactcatcgcctccttatttctccggaggcctgcagcggttcccatactctggttgggaagatctgctccagagcccacgagaatttgccttagcgccaaggtgggccggcactgctgggggacccagtgcaccctccacagctgctggcccgggtgctaagcccctcactgcccggggctggcagcgccagccggccgctcagacagtgggcccaccgagcccacgcccacccagagctcacgctggcctgcaagtgctccatgcagccctggttcccgcccgcgtctctccctccacacctccccgcaagctgagggagccggcctcggcctcggccagcccagaaaggggctcccacagtgcagcggtgggctgaagggctcctcaagcatggccagagtgggc

SEQ ID NO: 466597 - DNA, 1287 bp, Homo sapiens
atccgaggattccacagatcttggagcatcaccaggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactcagaaat

SEQ ID NO: 466598 - DNA, 3058 bp, Homo sapiens
ggaagcaacttctttctaccggatgtacaaatataacccagggatactagtgaagcacactcaaaggttgcccacgttcagagttcttgtgggcatccctgtgcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagaaatcagcttgggatgtttgtaaataggaaacagaaattttccctggctattttctacccacagctgtgcatgatcaacagatgttagccctttctgagcagaaaagaatcaaacactggaagatggcatctaaactcatcctgcctgagtccctgagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactcagaaat

SEQ ID NO: 466599 - DNA, 3330 bp, Homo sapiens
ggaagcaacttctttctaccggatgtacaaatataacccagggatactagtgaagcacactcaaaggttgcccacgttcagagttcttgtgggcatccctgtgcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagctgtgcatgatcaacagatgttagccctttctgagcagaaaagaatcaaacactggaagatggcatctaaactcatcctgcctgagtccctggtgagctgttatttctggcttttttcaggtgacttgactgtggccttgcctctgcttgtccctattgcctaggactcatagtgtccagcaggtgctttgaggcattttagccccagttattctctaggcaactaggcttggcacagtgggaactgggcacctcccaggtgatttactgatcctctttgctccttcctttctgccttctcacttttttcccctaaatcttgtactgttcacatcttcagcacctggcctaccatgtaattcagaaatgggtggtaggacagcttctgaagtggcaagtactaaactatagcccattctcttctttagagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactcagaaat

SEQ ID NO: 466600 - DNA, 3394 bp, Homo sapiens
ggaagcaacttctttctaccggatgtacaaatataacccagggatactagtgaagcacactcaaaggttgcccacgttcagagttcttgtgggcatccctgtgcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagaaatcagcttgggatgtttgtaaataggaaacagaaattttccctggctattttctacccacagctgtgcatgatcaacagatgttagccctttctgagcagaaaagaatcaaacactggaagatggcatctaaactcatcctgcctgagtccctggtgagctgttatttctggcttttttcaggtgacttgactgtggccttgcctctgcttgtccctattgcctaggactcatagtgtccagcaggtgctttgaggcattttagccccagttattctctaggcaactaggcttggcacagtgggaactgggcacctcccaggtgatttactgatcctctttgctccttcctttctgccttctcacttttttcccctaaatcttgtactgttcacatcttcagcacctggcctaccatgtaattcagaaatgggtggtaggacagcttctgaagtggcaagtactaaactatagcccattctcttctttagagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactcagaaat

SEQ ID NO: 466601 - DNA, 2711 bp, Homo sapiens
gagtatagttctttatgagaacatagtggcacaatacctcttcattctttttattacttctctaatgtcatgcattccccaaatctgggctctgctcttgttcctccctccactaccaccccaaaaccaaaagtaagttctgtgctaatgaggatggggattatttctaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagaaatcagcttgggatgtttgtaaataggaaacagaaattttccctggctattttctacccacagctgtgcatgatcaacagatgttagccctttctgagcagaaaagaatcaaacactggaagatggcatctaaactcatcctgcctgagtccctgagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactcagaaat

SEQ ID NO: 466602 - DNA, 907 bp, Homo sapiens
ggaagcaacttctttctaccggatgtacaaatataacccagggatactagtgaagcacactcaaaggttgcccacgttcagagttcttgtgggcatccctgtgcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagaaatcagcttgggatgtttgtaaataggaaacagaaattttccctggctattttctacccacagctgtgcatgatcaacagatgttagccctttctgagcagaaaagaatcaaacactggaagatggcatctaaactcatcctgcctgagtccctggtagtgtgtcgacgacattaagatgtctctctgtatattct

SEQ ID NO: 466603 - DNA, 1938 bp, Homo sapiens
catagaatttctggaatttactatgataaagaaagaagaaaaaggctctggtgagaaacccattgtaccttctggatatgatcactacccaattttatcagtgtcattgatcactaacccagtgcctcgtatggtgccaggcacagagttactccaagaatgtacaataatggctggattctctttctccctgtgcaactcttcatgcatatttgaagggcagctgtcctcaggagacccctggcacttccctccatggtgggatgtgatgcctgattccagtgagttcatagagctgaacaaaaggaggcagcagatggctgaaattctgatccgatgtggctggttaatgcatgatctgaaaacccctgcactggtgattttgggacagatctagaatataccaataaatatattaacataccaagtagtctaggagcagccactgggcgaacaccaaaccttgcatccctgctgctgtctctgagctcagcagacacgtctttgcagaagagttctataatggtggtacaatggtgccccctcgtgacagaagcttgaactacagcttgaacatcgagatgaaaatatactgtctacgttgttcaacacaatagctaatggcaactgtggcagttgaacacccgaaacgtgatgaatgtgactgaggaactgaacttttagtttcattgtgacatgatgaatgaatttattgagccccaggaagaaggaaaattaaagaagagcaaagaataatagctggacagaagatgggggtcattgaacctatatcctagttgccagaccagtaaactgaccatgggacctgggggaggcagcagatgaccgaaaacctggagtgatgtggctgaataccgcatgatctgaagactgcactggtggctgcggtatgggtccaaatttttccttaacaaaaacaaaaaaagagcccaaaaccatactgactagtccaggaatagccattaggcaaacaactttttgctaccctggtgttaccgatttctgaactcaacaggtgaattcaaagatatgcctgtctttccagcatggggagctggatttgggtcagctcaggcgcatgatgttgaacagctcttatgagcttctgatagtgcccaggaagtacagaaacaactgtctacaaatctttgaactcaaggcatatcacagggacatttgctttcttcaactagatatctgttttctcataaagagaaacaatgagaaatggtttttcacaatgcctcgttagccctgaggctcagccatcccctagtgctgtgtcccaacatttaaaggccgttgaagtcccactctatgccatatactctgtacaggttttctcatttacccctcaggacagcactgtaaggatggtgtggtcagtcccatttcatagatgaccaaactcaggctttcagagcctaagtcacttctccagataggtggtaggattgaaatgaggttccatccctcatcatccatagacagccctgagtagcctcccttttagaagatgggcttccagggcttgagaaatggtcagattccacccccctgctattgtggaccaatgcgtcctcactccacaacccctctgggtgatgaagaagatagagaagattaaatcccaccatttatgccaagagacctgggtgtagggccacatgagttggttgcttctcgaagtggtgagtgggctcaggcagaagctcaagtgttggccttgggacaggtgagctggagagaaggaaagtaacatacactaaactactgtaagaaaatgcactttatatttcatctcctttaatcttaactgctattcaaggtacctatcactttgacaattattcaaatcagggtactttaggaaagtttatgtaaagcagggaataaactcttttctctccagttcag

SEQ ID NO: 466604 - DNA, 413 bp, Homo sapiens
ttaagtgtctgaaggaggttcgttctgaggatctgggacatgatgggtgctgaagcttctactcaagatttgaagggcagctgtcctcaggagacccctggcacttccctccatggtgggatgtgatgcctgattccagtgagttcatagagctgaacaaaagtacgttgtggaatagctcctgtgaggttcacaacatagtccggaagatgagaaactactttttttagtaacctggattcccatctaagagatgccttactttatcgtaaagcaatgagttgttcacttgaggagggaacttcatgtttaacatgtatttgcaacaaatttacatacattttctgcctgtatgaatagttgtcagtgatgcccatgaatttctcagatggatgttgaagtatacagttaga

SEQ ID NO: 466605 - DNA, 1827 bp, Homo sapiens
catagaatttctggaatttactatgataaagaaagaagaaaaaggctctggtgagaaacccattgtaccttctggatatgatcactacccaattttatcagtgtcattgatcactaacccagtgcctcgtatggtgccaggcacagagttactccaagaatgtacaataatggctggattctctttctccctgtgcaactcttcatgcatatttgaagggcagctgtcctcaggagacccctggcacttccctccatggtgggatgtgatgcctgattccagtgagttcatagagctgaacaaaaggaggcagcagatggctgaaattctgatccgatgtggctggttaatgcatgatctgaaaacccctgcactggtgattttgggacagatctagaatataccaataaatatattaacataccaagtagtctaggagcagccactgggcgaacaccaaaccttgcatccctgctgctgtctctgagctcagcagacacgtctttgcagaagagttctataatggtggtacaatggtgccccctcgtgacagaagcttgaactacagcttgaacatcgtgtgacatgatgaatgaatttattgagccccaggaagaaggaaaattaaagaagagcaaagaataatagctggacagaagatgggggtcattgaacctatatcctagttgccagaccagtaaactgaccatgggacctgggggaggcagcagatgaccgaaaacctggagtgatgtggctgaataccgcatgatctgaagactgcactggtggctgcggtatgggtccaaatttttccttaacaaaaacaaaaaaagagcccaaaaccatactgactagtccaggaatagccattaggcaaacaactttttgctaccctggtgttaccgatttctgaactcaacaggtgaattcaaagatatgcctgtctttccagcatggggagctggatttgggtcagctcaggcgcatgatgttgaacagctcttatgagcttctgatagtgcccaggaagtacagaaacaactgtctacaaatctttgaactcaaggcatatcacagggacatttgctttcttcaactagatatctgttttctcataaagagaaacaatgagaaatggtttttcacaatgcctcgttagccctgaggctcagccatcccctagtgctgtgtcccaacatttaaaggccgttgaagtcccactctatgccatatactctgtacaggttttctcatttacccctcaggacagcactgtaaggatggtgtggtcagtcccatttcatagatgaccaaactcaggctttcagagcctaagtcacttctccagataggtggtaggattgaaatgaggttccatccctcatcatccatagacagccctgagtagcctcccttttagaagatgggcttccagggcttgagaaatggtcagattccacccccctgctattgtggaccaatgcgtcctcactccacaacccctctgggtgatgaagaagatagagaagattaaatcccaccatttatgccaagagacctgggtgtagggccacatgagttggttgcttctcgaagtggtgagtgggctcaggcagaagctcaagtgttggccttgggacaggtgagctggagagaaggaaagtaacatacactaaactactgtaagaaaatgcactttatatttcatctcctttaatcttaactgctattcaaggtacctatcactttgacaattattcaaatcagggtactttaggaaagtttatgtaaagcagggaataaactcttttctctccagttcag

SEQ ID NO: 466606 - DNA, 2043 bp, Homo sapiens
ggccctcggcctctttgcacccggcagagtgacgagcttcgccggtgtcttcaacgaagtcctgtcggtccctaccggcacatcacacactcctggaagcatgatcttcactcccttccttccacctgctgacctgtctgtctttcagaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgcttgactgtttttgctttgtggcatttgatgtaactttcaacacgtcgggtgaagtgggggtggtcagctttggtggtggtggggttgtggagggagagagctagcatcttcctgagccctgttaggctgtccgccctcctcctcgaggcagcgctgcttgttcctgggtcctggtggcgatgggctgtggccaatcaatggtgagttttccacagctggcagctcggaccctgcctgagattgcaaccacactggcactgtcccaggtactgatacttgctccagccatggctctagccctggcactggcaactggcacttgcattggtgctggtgctgatgcttgcttcagccatggcataggccctggaactggaactggcactaacactggcacttgtcacgtcaccaacggcagctgccatctcgggcacggggtatctcctcctcttctctcaatgcctcatttactgccacggaaaggaactggggggtttctggggtccacaaaggaactttcagaagcacctgagcaggggctccatgcctcagaagaagtgctcccagggctccggggagcacttggtgtccccgctgcaggcgcccccgtgggggtttcttgggcaaggaggagaggagcaggccaccgggcctctgagacccgcaggccctgggtgtcacctctaccgcggacgttctcacctgcggctttggctggcccaggaagcaggaactctgggaagagatgcgcgtccacgggcattcggcggccggagcgctgtgtgccaggccgagaggacagtgacgtcgccgcggctgctgcggcggctgctaagaagacccggagccccagggtcttgagtcggagaccgccgccctcagaccgggaggaggaggagaaggaggaggaggaggaggaggaggaggaggaggaggagcaggaggaggaggaggaggaggaggaggaggaggaggaggaggaggaggaggaggaggaggaggaggaagaagcgggaggggagggggctaagcctccgccgcccgggtcttcccggagctgtgggaatgggcgggcgccgccccgcagtgcctcttctggcagaaaacagtaccgcaggctacagcctgagggatgcgggggcgctgctcccagaggtggggctgctcatgtgaggcttgaaagagaccataagcctaaaagccaggcccagtgtaagcgcttaataactgttacctgttgttgtgatgaatccgatcattctggattatcttcgtatccctccttctctcctgtggagaaggctcctaagagcgtaggcatttctgtccagcggctgcctctgcagcttcctcttcagatcatctacctgaagttgctttgctcagtgcctggcctagagtaagcacttaggtacttcaatcaccttttagtttgctttatatagcttttgcataattcttaagtttgtccatggcagtctttttagtttcattgctgctatgaattgtgtatttcccattatgtcttctaattacttatttctgacatataggaagcctactggttttgtatactttggggcatac

SEQ ID NO: 466607 - DNA, 1260 bp, Homo sapiens
catcacactacctgacttcaaactatactacaaggctacagtaacaaaaacagcatggtactggcagccagtgaccaaggcttagaacctgccccagaccacaagcctccccattacaaatgcaagcagactcacagtttttcagcatctaagggagcctgcagccatgatccagtttctttaaaggtctgtggattctcccagctttcctggtatgttcctgcagcagttcttggagaaaaaattcacagtgtgattctccacacactgctctgtccatccaagtgggagctgcaagctagtcctgctgcctcctatctgagtaaagaggcaaggagagagagggtttatgagaacctggattggaaagctacacggagaatgcaaccttacctgactcttcataaccttgtaaaaggacacagcttatctgcagttaataaccggcagagaaagagcagaaggatataagaacatcaacttaatttcccaacttcactgtgatctgcctatcaacccacacccatggaacaatcctaatcagaagacacaaggtatgagactgacagaggagtctctgtcttacgcattgtctgtcatgtaccagttggaaaagagagtgctggattattggcaattaaatactcaatttgtaagttacatctgctcacaattaattgaccacaattagtcatgtgacttcacacaaccgcgttggacctaaatgtgcaatcttatcatgtatctaaaacactgagagccaggaaatatgatgaccaaaccactgtgaagctaaggatactttccttgtgaagattgagcatggaagatagtggcagatagaccaccagatgtgtccaacaacaaagcaaattaagtcactggaaaagagaaaatatatattaataaacattaataaatatatttattatagtcttatttccatttatattgtgaaagaattttatagtttaagtaacatctcttgcctttctataaattagcatattgtgaagtttttattaaagaacaccattattgagcaaatgacattagaaaatacaattaggaaagaaataatatagatactaatcataaaattaatattatctaaggagttttttaaaagttgatagaaacttggttatagtgtttcaacttaaaatggtatattaaatagtatcaaacaatattttttcatttactcattcttctgacaggcatttaaggaatgctaatgtcatttgggaactgcaaatc

SEQ ID NO: 466608 - DNA, 1242 bp, Homo sapiens
caggcaggctgcaggcagcggataggacacagagacagacagacagacacacgcgcgggggatcgaagaccgcccagatacccaagatgcccactggatagagtgattaaccatccctgttaatgtggaacagagaggtttcctgggatactggactttcagtggtaaaagttggaaagtctaagctggctggcaaaatgtaataatgtgaaagaagaaaactctaggaagaaacttcaacagtaaaatgaaataaaatactaagaggattttcaggaaacgctgtttggaaggcagaagggagacgggacaaatagcaagattttaaagtgaagaggccggcccaatataggccctcgggagctggaaaggaaggccacctagtggcgtttgagcgaaggacacagcttatctgcagttaataaccggcagagaaagagcagaaggatataagaacatcaacttaatttcccaacttcactgtgatctgcctatcaacccacacccatggaacaatcctaatcagaagacacaaggtatgagactgacagaggagtctctgtcttacgcattgtctgtcatgtaccagttggaaaagagagtgctggattattggcaattaaatactcaatttgtaagttacatctgctcacaattaattgaccacaattagtcatgtgacttcacacaaccgcgttggacctaaatgtgcaatcttatcatgtatctaaaacactgagagccaggaaatatgatgaccaaaccactgtgaagctaaggatactttccttgtgaagattgagcatggaagatagtggcagatagaccaccagatgtgtccaacaacaaagcaaattaagtcactggaaaagagaaaatatatattaataaacattaataaatatatttattatagtcttatttccatttatattgtgaaagaattttatagtttaagtaacatctcttgcctttctataaattagcatattgtgaagtttttattaaagaacaccattattgagcaaatgacattagaaaatacaattaggaaagaaataatatagatactaatcataaaattaatattatctaaggagttttttaaaagttgatagaaacttggttatagtgtttcaacttaaaatggtatattaaatagtatcaaacaatattttttcatttactcattcttctgacaggcatttaaggaatgctaatgtcatttgggaactgcaaatc

SEQ ID NO: 466609 - DNA, 1396 bp, Homo sapiens
gatactcagatacccatctggcttcctggctttcctatctagtatgattgccccttctcctaagagcagtgaagaggaagggcaaaaggatgaagaagttcttcagggagaacaaggagattttaatgataatgataccgaaccagaaaatctgggtcacaggcctctcctcatggattctgaagatgaggaagaagaggagaaacgtagctctgattctgattatgagcaggctaaagcaaagtacagtgatatgagccctgtctacagagacaaatctggcagtggaccaacccaagatattaatacaatactcctcacctcagcccaattgtcctctgatgttggagtggagactcctaaacaggagttcgatatatttggcgccgtccccttctttgcagtgtgtgctcaacagccccagcaagaaaagaatgaaaagagcctccctcaacacaggtttcctgctacgggactccagcaggaggaatttgatgtattcacaaaggcgccttttagcaagaaggtgaatgtacaagaatgccatgcggtggggcctgagacacatcccaaaagcatagatatatttgacttcactccatttcagcccttcctcacatcaacaagtaaaagtgaaagcaacgaggacctttttgggcttgtgccctttgaggaaataatggggagccagcagcaaaaagtcaaacagcgcagcttacagaaactgtcctctcgccaaaggcgcacaaagcaggatatgtccaaaagtaatgggaagcggcatcatggcacgccaactagcaaaaagaagactttgaagcctacctaccgcactccagagagggctcgcaggcacaaaaaagtgggtcgccgagtctctcaaaccagcaatgaatttgtaaccatctcagactccaaggagaacattggtgccgcagtgactgatgggaacgatagggggaacgtcttacaactcgaggagagtctgttggacccctttggtgccaagcccttccatcctccagacctgtcatggcaccctctacatcagggcctgaatgacatccgtgctgatcacaatactgtcctgcctaagcagccaaggcaaaattcactacatgggtcattccatagtgcagatgtattgacaatggatgattttggtgccatgccctttacagaacttgtggtgcaaagcatcactctacagcagtcccaacagtcccaaccagtcgaattagacccatttgaatcatggtcaaagtgtaggtcactccacacagctgatgctcaggtcattgcattatgagaattatgagaataaagctctcaagctttcagtttaggctggtcttttagagttccttgaggtataatgttagtttggatttttaag

SEQ ID NO: 466610 - DNA, 1121 bp, Homo sapiens
  misc_feature (1112)..(1113): n is a, c, g, or t
  misc_feature (1115)..(1115): n is a, c, g, or t
  misc_feature (1118)..(1118): n is a, c, g, or t
  misc_feature (1120)..(1120): n is a, c, g, or t
aatagaaagtttcttccttgggcaaggggtagggagaaggaatgtttctctaagatagaaagatctacaaaatcacttctttatagaccaagagtatgtctcagagccatcatctttaagccttggaattttaagatgcatattcccttctcgtcgtaggtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggtaagaatctccatggtcgtcgtgcagaaaagtggcaagaatgtggggcatgggtgggtagaccttaccctgaatatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtgnntngcnanc

SEQ ID NO: 466611 - DNA, 763 bp, Homo sapiens
ccaataaaggtctcccatgctgagaaaaataatcatggcatctcatgaaggaaagactagtccaagaggattaagttcttctgttgtctggatggatgatcttgtgttccccagattttgcccatgatttccttctcatgcttatttgcaaaagattacacacattcatcccagcttagattaaaacagcttccaaagcccttgagggcaactgtcttagagtaacctctctgtgggaagagtaactttatgaaaaataagtatgtggaatcgtgttggagaaatgtctttagacttatgatcagaaatatctatgtattctgtatatttgtattattgaaatgtatcgataacaaaactttttatctgcacacacacacacacacacacacacacccctggttccaggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaaaaaagtcttg

SEQ ID NO: 466612 - DNA, 371 bp, Homo sapiens
aagccgtggtcactgcagttttaattctctggctgtattttcccaaatgtctccacggaggagagttcagttgtgaaaccaaacctcatcggaaatatcctgtcttttgccaggagccttaagaaattgctcagctagcttgaccaacttaatggcttcccaagcattcagaaggcacacatacttacacttgccctgagacttagttcgaaagtatttacaaacttttaaaaaatgacaagttaatatttggtcatggaagtggtcaaatatagctgtcttttcaagtgcatttaccaattcacagtattctgtttgcagtgtgaaatatgatttggcgaggaagatcaacatataggcctaggccgagg

SEQ ID NO: 466613 - DNA, 547 bp, Homo sapiens
ccctcggccccttttcccacgtggtgaatgccctggagttgtgagggtgtgagggtcgcgttcctgctgtctggactttttctgtcccactgagacgcagctgtgtgaaatatgatttggcgaggaagatcaacatataggcctaggccgaggagaagtgtaccacctcctgagctgattgggcctatgctggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaaaaaagtcttg

SEQ ID NO: 466614 - DNA, 1305 bp, Homo sapiens
ggctattccatcatggcgaggatggcggtactgtggcggaagatgagagataacttccagagcaaggagttccgggaatacgtgagcagcactcacttctggggtcccgcgttcagctggggccttccgctggctgcctttaaagacatgaaggcgtcgccggagatcatcagtggccgcatgacaacagcgctcatcttgtactcggcgatcttcatgcgcttcgcctaccgcgtacagcctcgaaacctgctgctgatggcgtgccactgtaccaacgtgatggcgcagagtgtgcaggccagtcgctacctactctactactacggcggcggcggcgccgaggctaaagcccgcgaccctccggctaccgccgccgctgccaccagcccgggttcccagcccccgaaacaagcttcttaagaactgagagggcctgatctcatctctgcaggtcacaagcactgaactgccattcctcctgaaaaaagaccaatgaagacctcggttttgactctaaaacagtgcgaatctgacttaaacctgcagtttgattaataaagaaatacaaagtaacattgaaccgaagttgagtgttgccttttttgtaaactgaaaatgttttttagaaggggagggtggattagctggtctttctcttcacaggacctgcaactcaagatagtttatatgggggaggaagactttgaatgaaaagcacttcacagtattcactaactcgtagcttttttgttttttttttaaagctctcttgggaacgtatttctgttacttgttttggatgtccagagcgaacagggttgcttagtatcacacatgactcacagcttggtgcagtcacaaatctgtatatcaaaaaaagtctgggggctctttctactgagggaaatgtttcgaagtgggttttaaatgaatgtcgtgaggtacagtgtagcctcaagagaacctaggatctcttggcgacggagagcaattatagaatctgccatggagacaggataaacaattctgaggacaattgccatcaaccctggattctaggtaaataggaatcttgggggttcctacggattcttaaaccacagagccgagaaaagggaaacgagaagggtggggtggtggggcagtaggctaaggccattacctacatagcagaggctgccctctacgatttgacccaaaaatttcccctgtccctgcctctgaaggatgcggaaagttccagagtgtttactggtgaaccccaaagtaggtgtttagaagtgtttgaaccctgctttagat

SEQ ID NO: 466615 - DNA, 2000 bp, Homo sapiens
agtttttggcaattatgagtagagctactttaaacaatcatgcacagggttttgtgtgaacataggttttcatttctgtggagtaaatattggattactaggtcatatggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaaagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctac

SEQ ID NO: 466616 - DNA, 890 bp, Homo sapiens
tgccctcaagatgaccaagtgggagacagaagcaccagtggtggcagaaacccctgacatcaagttctttgggaagtggagcactgatgatgcacagatcagtgacatttcccttcaggattacattgcagtgaaggagaagtataccaagtacctgcctcacagcatagggctgcaagaaccctctgcaggttctggtgaatgccagcatcaaatgtggccctgggaggactccacatatatcgagcaagctgagactgtgagacagcaggatgtggacatgtccccactgtaccatgtgaatcaagccatctggctgctgtacacagggcaggccctaatccactatgactgctgtccttataagaggaggaaatttgaacacagacacacacagagaggagaccatgaagacacagggagaagacaactatctccaagccaaggaaagaggccacagaagaaaccaatcctgccaactccttgatcttggcacctagtctccagaattgaagtcaactgccattttatgagctgtgagctgccctatggagaggtccacatggtaaggaactgatgtctctggccaacagccagagaggactgaatccttctagctaccacagaagtgagtttggaagcagatccttccccaagctgagccttcagatgagaccacagaccatgcactgcaccttgattgcagccttctgagagaccctaagccagagacatccaactacaccatgctcaagttgctgacccacagataccatgagataataaatgttgtcttaagctactgattttggggtaatttgctttgaagtaatagatagctaatgcaatcttcaataatataatgatctaaaataaaatacttttgttta

SEQ ID NO: 466617 - DNA, 1328 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466618 - DNA, 1068 bp, Homo sapiens
atgacctttcctctttatcttccttgttgtgcaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466619 - DNA, 670 bp, Homo sapiens
tttttccgccccctttttgggccccctttgttgcacgaaaaccggggtgcgcctatctttggggccccccccgggggtttttttttttggccccccccccttttttttttttttttttttttgttttttgtttgtttttttttgtaggtggtgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466620 - DNA, 953 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtacttgcgggctggggtttctttcccctgggtttcgggcagagaacccgtgcggggcgcgcccgaagcgccctttggtgtcccttgctctccccatggtctcggcccccctccttctaagcgcgtgtacccgcgacctgcgtctgcaagtgctgctccacacacagcggccccatctcggcccggtcttccctgcctcccgcttggcccctgtgctgtaagctcgcctggaccccaggccgggcggtgcatagctctgtggcctgtggccccgtgctcagcatgacctaaccagaattaagcagtggacaatgggatttaggccccccaaaccctcgtccgatgacaatgggaggggaagtgtgatttttctcccctcggatggagcgtgctcagctgtaggaatgtgactcaacttgctgaaatgattttctgctctgcggactggtgcaccctgtgacccagacagatgtggagggtcccaccgctctgattagcagaaccaaaccgtgagtgaggtgcacatgtgttattcttaggaccggccctcccagctcttggtttccaatgcctgctgagtagaagaccttcctagggccattaaccag

SEQ ID NO: 466621 - DNA, 419 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctcgcccctgagttgcagctcgctcctgagttgcagctcgcgcctgagtgctgctcgcccctgagttgcagctcgcg

SEQ ID NO: 466622 - DNA, 454 bp, Homo sapiens
aaaggaaggacagagagaggagtaggggcagctcaagggtggagttcagggccagggggcggggccacgggcctgaggggtgagggcggccactatttctgactgttctgttaggtgccacgtactgggctgggtgctcttggtgccttatctcccttcctcacagccatgtggaaactggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaat

SEQ ID NO: 466623 - DNA, 1379 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466624 - DNA, 1576 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtaaagaaaccaagtggaagagtgtttcctcctctggccgtaaagcagctcagatctgggacagggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466625 - DNA, 1525 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctcagatctgggacagggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466626 - DNA, 1916 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtaaagaaaccaagtggaagagtgtttcctcctctggccgtaaagcagctcagatctgggacagggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagcgtgggactgtccctctgtgctggaagagggctaacaccagccccgactctccgctctggctaggccgagggggccctctgtcctctgtgttgccctagggctcggtgacctctgtcatagcactgaccacatgctatcctgcctgtgccttcctctagctgtccccgccctactccggaccgccccaaagactccatgggatggacctgagtcagccgaatcctagccccttcccttgggcctgctgtggtgctcgacatcagtgacagacggaagcagcagaccatcaaggtcagtgcgatttaggccacctgagagacacggggggaaggtcaggccactgcccatgagcttgaagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466627 - DNA, 1240 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466628 - DNA, 1236 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466629 - DNA, 1157 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcatctggaaattcatcttaacctaaagaaaaaaggatc

SEQ ID NO: 466630 - DNA, 660 bp, Homo sapiens
gactactccgatgaggttgtgatagaagtagctgatgacactgagcagagtactgatgtgatttcaacccgagtgttctgggcctactagggaagggcagattattcagaatccatagaggttcagctggcgaatgaaactcgtcaagttgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttcgggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaat

SEQ ID NO: 466631 - DNA, 1501 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtaaagaaaccaagtggaagagtgtttcctcctctggccgtaaagcagggtactctctgcagcaccagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggatttactcctaatgattggttgcatgtgctccagtgggcccagataaagtgtttcttattccccttggtcaagttgtccccagagtggtgctgtgcctgagcatggtgggagcactcccctcactcgtct

SEQ ID NO: 466632 - DNA, 1815 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtaaagaaaccaagtggaagagtgtttcctcctctggccgtaaagcagctcagatctgggacagggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagcgtgggactgtccctctgtgctggaagagggctaacaccagccccgactctccgctctggctaggccgagggggccctctgtcctctgtgttgccctagggctcggtgacctctgtcatagcactgaccacatgctatcctgcctgtgccttcctctagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466633 - DNA, 1399 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtaaagaaaccaagtggaagagtgtttcctcctctggccgtaaagcagggtactctctgcagcaccagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 466634 - DNA, 1487 bp, Homo sapiens
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccagaatccatagaggttcagctggcgaatgaaactcgtcaagttgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttcgggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaat

SEQ ID NO: 466635 - DNA, 1243 bp, Homo sapiens
  misc_feature (1178)..(1179): n is a, c, g, or t
  misc_feature (1239)..(1239): n is a, c, g, or t
ggtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttnntttttttgattcttttttttgttttctttcattttttcaagttctttgtccttatgggtngaat

SEQ ID NO: 466636 - DNA, 717 bp, Homo sapiens
  misc_feature (14)..(14): n is a, c, g, or t
cgagctcggtaccnaaacgaccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccagaatccatagaggttcagctggcgaatgaaactcgtcaagttgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttcgggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaat

SEQ ID NO: 466637 - DNA, 1371 bp, Homo sapiens
tccagtggccaggactgggagtttacgttgtagcgtttgaaggacggtgggtgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatgacctgctcaatcgccatattctggatgacatcaggtgtgccaagcagattgtgtcctcacagaatgggctttctgcctggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaacaatgcaaaagatgctctgatgtctgactctcttcatttattcaatgcctggaggaagtgaggagcgtctctgcccggccgcccatcgtctgggatgtggggagcgcctctgccccgccgccccgtctgagatgtgaagagtgcctctgccccgccgcgaccccgtctgggaactgaggagtgtctctgccccgccgccaccccgtctgggaggtgaggagcgtctctgactggccgcccagtatgagaagtgaggagctcctccgcccgcagccgccccatctgggaagtgaggagcatctccgcctggcagccgccccgtccgggagggaggtgggggggtcagcccctgcccagccagccgccctgtccaggaggtgggggggtcagcccctgcgcagccagcagccctgtcagggaggtggggggcagcccccaccaggccgccgccccgtctgggaggtggggggcgcctctgcccggccaccccatctgggaagtgaggagcccctctgcccagctgccaccccgtctgggaggtgtacccaacagctcattgagaacgggccatgatgacgatggcggttttgttgaatagaaaagggggaaatgtggggaaaagaaagagaaatcagattgttactgtgtctgtgtagaaagaagtagacataggagactccattttgttctgtactaagaaaaattcttctgccttgggatgctgttaatctataaccttacccccagccccgtgc

SEQ ID NO: 466638 - DNA, 1440 bp, Homo sapiens
caagtcagaatgtccgaaaatgtctcagatggtctatttaaggagtcagccaaaacccaccaaaaccaaaatggcaatgagagtgacatctgtcaggcccctcttctgcaggtctgctgcagttttctggaggtccgctcaagaccctatttacctgggtatcaccagcagaggctgcagaacagcaaagactgctgcctgctccttcctctggaagctttgtcccagaggggcagcggcctgatgccagccagagcactcctggacccacttgaggaggcagtctgtcccttagcagagctcgagcgctgcactggaaaaaccttttcaggatgcactgctctcttcagagccagcaggcaagaacatttaagtccgctgaagctgtgcccacagccgccccttcccccaggtgctctgtcccagggagatgagagttttatctataagaccctgactgaggctgttgactttctttcacagatgccctgcccagtgaggaagaatctagagaggcagtctggccacagctgctttgctgccctgtgtcacgtggtgaatgccccactcagtgcgcatgctgcacagatctgttactgcagatttctgttgctacgcatgtctgttacgcatgcgccttgttgcctaccttctgtccatgcagagctttgtgagaagaggtagtatcttcattctttccaccatcttgattctttctctctgactgaggctcagccgtgggaaatatgagtgagcatgtaagaacaagatcccaatcctcagaaagaggaaatgactaagagtcttcccagccagttgtatctgtgattgtccagcagcccactgaggaaaaacgtcaagaagaggagccaccaactgaaaatcagggtattgcacctactggggagatcgaaaatgaagcggcacctgcccttcaaggacctgatgtggaagcttttcaacaggaactggctctgcttaagatagaggatgcacctggagatggtcctgatgtcagggaggggactctgcccactttcgatcccactaaagtgctggaagcaggtaatgggcaaccataggtttaaaccaagacaaatgaagactgaaaccaagaatgttgttcttatgctggaaatttgactgctaacattctcttaataaagttttacagttttctgcaaataattctttcatatttttgttaaatttatttctgaatttttaatactcccgagaactgtatcttttatgaaagtttaaatcctgtgtttgagatggtatataaagataaaatgttgatacattgattttctatcatagatagataggaagctggaagctttcatagggggatgccagcagctgcacagatagaaaaggccacatggggccagtcttgctagcggtctatctattttgttaatcatttcaaaaaaa

SEQ ID NO: 466639 - DNA, 911 bp, Homo sapiens
ctctctctcattgcaacccccatccccagatagccacagagctcctacatctcctccctcagatctttcccctgtcttgactccttccttgggtttttcgtcggccatggcaagcgccggaatctcctcagctgccgtttcacaaaagaggtaccaggtccgcaccaaacgagcacacaagcagcaccaggagctgcagaagaaggaggcggcagcgatggaccagggcagagggtgcgcgcacgtcgtgcgctccctgcctccaccctgcgtgcgcgagcacgagccgccggagcctcccattctgcggcatacgcgccaccagcagcatcccctggaaggctgcagaagcagcgctgggcccctagcagttccagaaaaaaagtgggaggtgatagggcaccggcagtgtctggtcttgggaagacgcctctcacctggggagggaacaattgaagctttcaataaccttctttttcctctaaaccgttttgtgaatgttaaacagtaaacttttcattttctcgatacatcagtctcctttgccctcttgccagcgaagaccttactcaaaggaaacaaatgggacaaataggaatggggagggggcatcctaccccatatctgaggtgcgactgcgggacgtagagcggactgggcctttcccgttggcgcgtggcctcaatcagagatggggttccgccatattgctcacgctggcctagaactgccgagctcaaagaatccacctaccgtgacgtcccaaagttgtggaattgcagtgcttcactggccccggccttatttccaaaatgaaataactcacataagttctgtggtgacatgtaaaaacccaattcccgtaacagctttcccaacgttgattttttagacatgatgaatgttatgtg

SEQ ID NO: 466640 - DNA, 1346 bp, Homo sapiens
tgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaagggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatccttacacagttttgttaaatttatttctggatctttaatactcttgagaattgtatcttttttgaaagtttaaatcctgtatttgagatggtacatagagataaaatgttggtacattgattttctatcatagatagataggaacctggacgctttcatagggggatgccaacagctgcacagatggaaaaggccacctggggccaggcatgtccaccatgggctttccacctcctcgtttttagcacatgcacagagcgctggtggtttactccacagaggcaggaaaacttcagtcacgaggcgaataccccactcagtgcgcatgctgcacagacctgttggtgcccatgtctgttgctatgcgtgtctgttgttgcgcaggcgccttgctgcccgtcttgtgtccgcacagaggtctgcaaggagagagagtgtcttcattctttccgccatcttgattctttctcactgaccaagactcagccgtgggaaatatgagtgagcttgtaagagcaagatcccaatcctcagaaagaggaaatgaccaagagtcttcccagccggttggatctgtgattgtccaggagcccactgaggaaaaacgtcaagaagaggaaccaccaactgataatcaggggcctgacatggaagcttttcaacaggaactggctctgcttaagatagaggatgagcctggagatggtcctgatgtcagggagggtattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatccttaca

SEQ ID NO: 466641 - DNA, 1339 bp, Homo sapiens
tgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaagggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatccttacacagttttgttaaatttatttctggatctttaatactcttgagaattgtatcttttttgaaagtttaaatcctgtatttgagatggtacatagagataaaatgttggtacattgattttctatcatagatagataggaacctggacgctttcatagggggatgccaacagctgcacagatggaaaaggccacctggggccaggcatgtccaccatgggctttccacctcctcgtttttagcacatgcacagagcgctggtggtttactccacagaggcaggaaaacttcagtcacgaggcgaataccccactcagtgcgcatgctgcacagacctgttggtgcccatgtctgttgctatgcgtgtctgttgttgcgcaggcgccttgctgcccgtcttgtgtccgcacagaggtctgcaaggagagagagtgtcttcattctttccgccatcttgattctttctcactgaccaagactcagccggtaggtctgcagaacggtgttactgggaatttagttgtgagagaatgtgtggaggagccagctggctttggacaggtcctgcggcacagtctgtggcttctgagggaaaagggcctcggggccgtcatccagctcctcccagatgatcctacctccagccctcagtaattggttgctcatttagatcagaacgctgaggcacaaagaacttgtgtaatttgcaaatgattgcagagttttaaaatagcatagaagggattagaattcatggaggttattttggagtataataaaatgcatccttaaaaaaaagctaccttgctcattgtgttagtagggatgattctgaatgaaagtaacagaatattcctacctaaactgtttcaagccacgaagcaa

SEQ ID NO: 466642 - DNA, 1133 bp, Homo sapiens
ttaatgaatttactatttattaagtggaagcggatcaccataaaggtcttcatccttatcatcttcccattgagtagatggagggttggtcctgctgtctcagtaatggcagagcagatagcaaactcacatacaggtggacatgtgcagttcagccctgtgttgttcaagggtcagctgtacagtcaaggttatccttctctaaattacatggagatgacgttttatcaaggcttttctcatctgttcaattctcaccttctcagcatgaaaacagaatgcccagcaggtggtcctcatgacccctcaaagagaggttcccccaagcaatcatgattcaaatattttcatcttaagtagcttgaacgttagccttgtcacccaggtgaatttagtctcatgattaggtaactatgtatttcatatgttcatagtctatcttgagctttaaaagagatttatggcatcatattcacagctacgaaggttcataattttggggccacttctacagtcatttcatacaatttatttgtgaaatatagaaaaaaactattcaataatcaaatccagttatttttcttttacatttatttaaaatgattaaaaatagtttatgacagttttagaaaatggaatggattaaaggctaaaaatgtttagattccatttaagtaggtgtgtgtgtgtgtgtgtgtgtaactaaaaacacaggttttttcacaagaatttaattaagctcatgctgaaactcttatagggaaaatagtaattgagcatcagacatcaccactcctgaaaaaaaccttctacaagaattgaaaagtgttgcaggacctaatactgaaataggaaatatggactatcttcaaattgcacaaatgatgcatgaatccacatctgagacccgcaactccgaggtacctaatgtgaatgattaaagatattttacaaaccggggagccctttcaagtgctttccactttcaaccttctctctttgaagaccccaattcataatggtgagcataaaacatgcatactgggaatttttatgggccccatatatacattccagactgtacatgaatgtcttgatctttggttctgatatttatggcaaagtctaaatgt

SEQ ID NO: 466643 - DNA, 1114 bp, Homo sapiens
gaaactgtcaatggcaatcaacgcaagctacagtcaggccttcctgatctagatgaatacctaggatgatcgatggtctgtggataccaggcactgtgctgagggctgttcctgcatcagctcagccttggggacagggggtccactttcaaatccgtccagcccctgaggcattggggaaatccttaggagccaagaagtgccccggcggagccccctttgccagtacgacctcagttttctatcctctggatgccagccccaaagaagagaaatgccaggatgaagctggcccctccaaggaagtctcagttcttgtgcaaggaaggggagactctcccagcttctatgctttctccttgttggctccaatagtcgccagatgtctgcacagccttgtgctgccaactcgttccatggggcctgtgttggcttctcattgctccagcagggaaaccgtggagtgctgtgctcttgctctggagtataaggcactaagtcacaaggcaaccctcatgatccccgggcaaaagggtagctctgtttttaaacccggaggaggcatcttcccccgggggttgccgggcttctgttcctgtgtgtgttggtctccaggaagccatggagagcttggcagcagagacagagtctcgatatgtcgccaagcttggtctcaaactccaaggctcaagtgctcaagtgatccacccacctcgacctcccaaagtgctgggattacagggaaaatagtaattgagcatcagacatcaccactcctgaaaaaaaccttctacaagaattgaaaagtgttgcaggacctaatactgaaataggaaatatggactatcttcaaattgcacaaatgatgcatgaatccacatctgagacccgcaactccgaggtacctaatgtgaatgattaaagatattttacaaaccggggagccctttcaagtgctttccactttcaaccttctctctttgaagaccccaattcataatggtgagcataaaacatgcatactgggaatttttatgggccccatatatacattccagactgtacatgaatgtcttgatctttggttctgatatttatggcaaagtctaaatgt

SEQ ID NO: 466644 - DNA, 1372 bp, Homo sapiens
gaaactgtcaatggcaatcaacgcaagctacagtcaggccttcctgatctagatgaatacctaggatgatcgatggtctgtggataccaggcactgtgctgagggctgttcctgcatcagctcagccttggggacagggggtccactttcaaatccgtccagcccctgaggcattggggaaatccttaggagccaagaagtgccccggcggagccccctttgccagtacgacctcagttttctatcctctggatgccagccccaaagaagagaaatgccaggatgaagctggcccctccaaggaagtctcagttcttgtgcaaggaaggggagactctcccagcttctatgctttctccttgttggctccaatagtcgccagatgtctgcacagccttgtgctgccaactcgttccatggggcctgtgttggcttctcattgctccagcagggaaaccgtggagtgctgtgctcttgctctggagtataaggcactaagtcacaaggcaaccctcatgatccccgggcaaaagggtagctctgtttttaaacccggaggaggcatcttcccccgggggttgccgggcttctgttcctgtgtgtgttggtctccaggaagccatggagagcttggcagcagggaaaatagtaattgagcatcagacatcaccactcctgaaaaaaaccttctacaagaattgaaaagtgttgcaggacctaatactgaaataggaaatatggactatcttcaaattgcacaaatgatgcatgaatccacatctgagacccgcaactccgaggtacctaatgtgaatgattaaagatattttacaaaccggggagccctttcaagtgctttccactttcaaccttctctctttgaagaccccaattcataatgagatttctttagggcatcctctgctctcaaatcccaagtgattcttcaaacccaggagtgtggagccggcattgaaccaggaagccacagcagatctttcttctcccctatggtctgagcgcaccttcggaatttcagagaggcttataattcagtgtttcggtagttttctttgcgggtggggttctgggcaaaacattcacattcaacccaggtatttttcctgactcgcctgtgacgaaaatttcactgaatacaaaacagaacagaactatatttggtagttaaaccaaccgtcatgcttatagtcttgcaatgtaggtggtaattttgtgtgttggtttctttttctttcctttttttctcctcctcttttacattagacagataatgtgccagcctcattgtaacaaggtttagaggaaggtacagctcacacctgaccatgaaaacccaattgttggccaggca

SEQ ID NO: 466645 - DNA, 1068 bp, Homo sapiens
agcagttcctgctctacaagttcaaaatgaaacagcgtattttgaaggaagatatgctgaagattgtcaacccaagataccaaaaccagtttgctgagattcacagaagagcttctgagcacattgaggttgtctttgcagttgacttgaaggaagtcaacccaacttgtcacttatatgaccttgtcagcaagctgaaactccccaacaatgggaggattcatgttggcaaagtgttacccaagactggtctcctcatgactttcctggttgtgatcttcctgaaaggcaactgtgccaacaaggaagatacctggaaatttctggatatgatgcaaatatatgatgggaagaagtactacatctatggagagcccaggaagctcatcactcaggatttcgtgaggctaacgtacctggagtaccaccaggtgccctgcagttatcctgcacactatcaattcctttggggtccaagagcctatactgaaaccagcaagatgaaagtcctggaatatttggccaaggtcaatgatattgctccaggtgccttctcatcacaatatgaagaggctttgcaagatgaggaagagagcccaagccagagatgcagccgaaactggcactactgcagtggccaagactgtctcagggcgaagttcagcagcttctctcaaccctattgaagtctgaagcttttttcatccagtcaagcaaatataacatcaccaaaagggattttttttggaaatacaaaagaacccccagtaaaataattgagataatgaaatagaaaaaaataataaaacatgatcttggttttcttcattcctttcagtcttttgttttataaaattaaattaaaatttataccttgatatgtttagcttaacaatgtaggataaattaaatttaataagttagatctcttgctcactctctctcatattccccaaacatcatttgagtacctgctttttggaaggctctgtaacagctcttctgtgtataacgggaccaaagccaccctaactaaagcccataatgttaaagatgttactgggaccc

SEQ ID NO: 466646 - DNA, 404 bp, Homo sapiens
  misc_feature (1)..(1): n is a, c, g, or t
naccacgcgttcgcggagcggtgggtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcatctgccttaatgtgtctgtgctgttaggaagaatttttaaaaaagaaaatatagtaaaaaactgtaaaggggggttgtactctgaggtgggatttttaaccgcattttgcaaatgaaaaaaaataaatg

SEQ ID NO: 466647 - DNA, 2378 bp, Homo sapiens
agcggacaggctggcggcgctcggtgtcgtgtgccggacatcctgtcctgctcgtcctcctgcataccaccctgcgccggtgcacactgacacggactcacttcaggctcatctggcgaatcgcggacccgaggaacgaggcttcagttctttgccgcctgcaaggcggagaccagaaggcggaatccacagctggcgacgcgggagcatctgctgtccaccagcggagcacaggccatcaaagccgcatctgaacttgaattctgtgcagctgattgcagagctggacccggatctgcgaccccctgtggacagaggttgaccgtaccccggagaggagctttctcacggagggcactggttgcagaggctggaagtgaaataaagacgcgctcttgtttcagagttcgtcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcatctgccttaatgtgtctgtgctgttaggaagaatttttaaaaaagaaaatatagtaaaaaactgtaaaggggggttgtactctgaggtgggatttttaaccgcattttgcaaatgaaaaaaaataaatg

SEQ ID NO: 466648 - DNA, 2373 bp, Homo sapiens
tgtctcagctggcagaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggccatcaaagccgcatctgaacttgaattctgtgcagctgattgcagagctggacccggatctgcgaccccctgtggacagaggttgaccgtaccccggagaggagctttctcacggagggcactggttgcagaggctggaagtgaaataaagacgcgctcttgtttcagagttcgtcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcatctgccttaatgtgtctgtgctgttaggaagaatttttaaaaaagaaaatatagtaaaaaactgtaaaggggggttgtactctgaggtgggatttttaaccgcattttgcaaatgaaaaaaaataaatg

SEQ ID NO: 466649 - DNA, 3773 bp, Homo sapiens
cctgcctcacgagacacttgggacagcgcagaattctcttcctgcttctcctgtcttcctaacccccaaatgcaggcagagcagctgcttctggcttgcaaggatggctttccggactttggccaggatcctcctagtaaccccttggcccaagcccgggacggccactgtcctgtgggaaaggaggccaggagggcaggccttgaacaactggcatgaaggagtgaggcccaaggaaggtccagagcccacccagcaggctagagggagaacggctgcctttgggtcctcaccagcttcaacagggatccaggtccttgccctgcctgtttaccaggcctgtggtgggcagggcaatgagtctctgctgcctggaaggcttgccactatctgtttcatggatacaaagacagaagggaacatcctgttcagagaagaggactccacatccctgagctcagcagtggtcgggcccacatcagagctcatagctgctcgtgctgtgttacactgccctgtctcaggccccgaggaggagacagacagggaaacatcattaacatggaaggtaccaggaaagggtcatataatggaataccacacagcagtgaaaaagaacatggccacatgtaacatgtaacaacatgggcggctctcccagatgtgatgttaagtgagggaaatacagcataaagaaagaacatactatggcatgctatatttatattccatggatatgaacttcaaaaacatgcggaaccaacctacagggagagaagtcaaaatagtagtttcccttgggacagggattactgattgggaagaggcacacaagagccttctggagtgctgaaaatggtctatatctcgacctaggtggtggttacagaggctgatacatattatgtaccaatgtgctggagctggctttcactggctcttcccaactcagtattcaatgacttcacactgccagcttgagatgagccatgatgggaatgtcagcaccacagaagtcagcaggtgccgcagatgccctcctttaagcagatcactcagcattttccagtacaccctgtacacaacactatttcagatcatcttatgtatttgtcagcttaccgatctgctgtatgtctcctctacatgaagtttcatgagggcagggtctatggcttgtcatttttgccactgtatccctggttcctagaacaatgcttgttgtatagtaggtatccaatacatgctgcttgaatgaataaaagtctgagggaaacactggaaacacaagagaggaaactgttacctttgtacctgaatacggaatatttgagctgaggcttcaaccataaaaaagagtttgctaaggagccaagggagaaaggacttcccaggcagagggaataaaatggaggcatgaaagagcatgggaggtctgggggaaagccagccgccagagtggctgtattgtaggtcctcagtgaagatggaaaacagctggctcttccctcaaagctcagtggccctctaggtcccaggccttagtttccattggccacatttctctgtctggcctagctctgtgggggcagcccctgtggccttgccaagatgcccaaaggcagtaggttcggccctgaatgcaaagctcgaggacagggagaaaagaggacagagtggagacaaaggagactgaaacaagtggatgggttgaaaagatgtttagagattgcttagaatagcagatttcctataactggcacttgtaaataagggaatggtaaaagaaatgttgttaggtccacccagtagaatactatttgtaaaaacagagcaaaagatttctaatactgaacagaaagattgacaaaatatacttttaggtgaaaaatgcaaggtacagaacagcatgtagagtattgtattttgtggaagaaaggaagcaatatctattgtttgtctttccataaagatgcactggaaggaaacccaccccccaaataaaggtggtttatgtgtgtgttttagggggagtgctgaagttaatggagttgggtgagactccttactaaatctcgttttatatttattttgatttttcaatgtatttcctgtttagaaataaataatcttgaaagccaaagcaacttaggaagtaaaacgagcaggattggctatgaggttggtaatgtggaagatgttgaaaatgactcctaggcttgtgtaactagatgtaagggggtccctttgctatgataagggacaggagaagacagtaggtttggggaggaagatcatgagatcagtttaggacacattgagtgtgaaatgccttcaaaagagtgagatgactctttgaagaagtttggctgtgaagaagaagagagaggcagggaagtagctgcagaaggaagtaaggtcctggaaggtgggttggtttcttggtttcagtgggagacacctgggcacctgaaaagcagtagggaaagatccagttgaaagggagaacctggttgtccttgagccatgtcattgttaattatcccattttagggatgaggaaatgaggctctggaaggcccaagatcacatcgctagtaagtggcagaaccgaaactggaagctacatcttctgactcccagaccaatggagccatggaaaggtgctggcagggagccattaggagataggattaatgaggtcaccaggcccagaggctcagaagacacccacgtattctgaataatccctctagagcagttgtctcaactgggggtgattttgtcccccaggagacatttgacaatgtctggagacagtttggttgtcagaactcagggtgggggtgtgctattggcacctcgtgggcagaggccagggatactgctaacagtctgcctcactgccccccacccccagcaatgcacaggacagcccttgcaacaagtcaatagtgcccaggttgagaaaccctgctctagaagctccaggggttcagggagcttgtcagcatctccactctctccacaaatgcgagtatctttgttgtttttactatctttttatttctgtgatttgggcacattgtaaaacattcaaacaatgcaaaagtttttaaagtattaagtaaaagtcttgcctccctcaatcagaattccccagaggtaatggttgttattgtaactttagtaaacgggttgaaatccacaagcagaaaacttattttctccctcctatttcttcctaaacactctctgtgacctatttctcccctacttcttggatgaaatctcctgaagagccagaactttttgagacgctttcagataattaaaaaaaatcctccaattacctccaggaattaacatgtccagcctagtggaacagacaaaacccaaacttcactaaaaatgaaagctttacccttctcctccactgaggcctgtcaggctgcagaggccagggatgtggtcagtgtcttctctcttttctgtccctactggcttattatttagccagtttccctgttgatgcatattgaggtagtttccagttttttacttttataaacaatgttgagccatccttgtacctatgtttatctgtacacacttgttatttctttaggacaaatttctagaaatcaacgtgctgagaagtcatgggcattggttgtcacaaagaagccttaacttttggtcccaggttatggatatgtttggcagaaatgtttccactgaaatgtatccactgacagccaggaacacccctt

SEQ ID NO: 466650 - DNA, 1838 bp, Homo sapiens
ccctttgaccggaggccggaaacgcagggacttctgggggggaacccaagcttctaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacaggaggtcttgctggagttgctagaacaatgtgtggatggcttatggaaggcagaacgttatgaaataatttctgagatttccaagttgatcgttccaatttatgagaaacgtcagcgtaaaataatcagtgttgttttcactaaaccttcacttcaaaaagctgtcaaatttccatgttacccagggaagaggcatagacatgattctattctttataatttagcggagaacctaaaggtgctggcaaatgacagtggggtagatgtgaatgaaatgaagcatgatattaagaaatacattgtcattgaggaacagaaaaccacataccgcgtgttctcactcaagtgggagctgaacaatgagaacccatggacacagagaggggaacaactcacacagggcttgttgtgggaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggccatacaattacaatgtcattgctactaccacctatgaagcagtatagtttatttaataaaacaaaacctaagacctctaagttattagccctgaaggagaagcattctctgccccatctatacctttgatgaggcattggacagcaatagcattcttgtctggaaacatgaccggcgggcaaatatcaag

SEQ ID NO: 466651 - DNA, 1300 bp, Homo sapiens
agatgaggagatgcaaaaggggttcaagacagcttgcgatcgtcttctcccgccccttgccacctccccgaacacccgcccccgacgcccgacaacacccccgcccacttcaatccaggcaaatcataaatcctacccagtcggcagcatccagatgagccacaactcctttctcagcgcaaccaggccatgggagtgctccatcccctgcctcgcagttactgattctccaagccgggcgccgcccagtcctggtggggcttcccccacccctctccgcgccgggaaatcgcgcgctctttctttacctgcgctccactggtgggcagcgtatgctcccgcgtcgacagctctgtttcgccttccggtccccatagctctgcaggggaacaggatcgctggcgcctcctgggccgctaagcgaccccggggctgcccggcttagcgagtgcttcgcagagaggtagccgagtcgaggcagcgcggttcccaaggaagtcacggctgcggccaccctccagttcggacctccgggcagccgcggttgctttcagtctctgcccattgagacaaaagagcgtgacaagccgcgcgacgcggccaatcagcggggcgaggaggcggcctccccaagcagcctctggccctgaagctactgctagcaagactcgggagctggctggcgggggctgaggccgacaggcacgggagccggcgcggcgtcaagtggagctcggacgcacggaccaggcccatttccctttcatctacagcaatgttcttactcctctcctgctgtaaagccactcatcttcgatttccctgaggacttctgctcctacagactctcgacggagtaaagcttccgatagaggggaaacagattcgctactagtgttgatagtcaagttactaaggttctttatcaacgtctcggagcagatttgagaggcccctgaatcgtcccgggaattttcttcggtgagcatttgtggagactctgggatgtaggttggattaaacttctgtgatgggtccatcggcgtcttgacacaacactaagcttctcctggatctttgaaacgtagcagaaactgatgacggagcctcaaattgctacaaggtagccggaaagagcaagagtgagtgtacttcggatgaagggaatgtggaccctcaggactaaagcagtgggagaggcctgggaggtggggcctggggagggcgaggtctgctctgaagtcaccaagctcctgatcttagaagagatggtgggcgcaggctctggaggctcaagcgg

SEQ ID NO: 466652 - DNA, 953 bp, Homo sapiens
gtagagctaaagttattcaaatacattcagattacacagatcccttatgaattactagtatcatagtaggaagaaaaagatacaagaagaaaaatacatcctagaactcattatcaaaattattggtgtatagtctgttctagcatagattagctttctcaacctgctatataaaattaccagcaagaaaaaaaggtgcaagaataagatttatggctgaagtggcttggtgtcttgattctctattctagcattctcagaaggatcccatccgttagacacgcagaaactgcagggacatttgaatggtcttgattccttcttaactcccttaggctcctcgtttgttggtcttctttcatgcatacgaactctgccgagtaacatgtatctcgatcttgccatcttttctctctgcacagacagcaatgttcttactcctctcctgctgtaaagccactcatcttcgatttccctgaggacttctgctcctacagactctcgacggagtaaagcttccgatagaggggaaacagattcgctactagtgttgatagtcaagttactaaggttctttatcaacgtctcggagcagatttgagaggcccctgaatcgtcccgggaattttcttcggtgagcatttgtggagactctgggatgtaggttggattaaacttctgtgatgggtccatcggcgtcttgacacaacactaagcttctcctggatctttgaaacgtagcagaaactgatgacggagcctcaaattgctacaaggtagccggaaagagcaagagtgagtgtacttcggatgaagggaatgtggaccctcaggactaaagcagtgggagaggcctgggaggtggggcctggggagggcgaggtctgctctgaagtcaccaagctcctgatcttagaagagatggtgggcgcaggctctggaggctcaagcgg

SEQ ID NO: 466653 - DNA, 2084 bp, Homo sapiens
agatgaggagatgcaaaaggggttcaagacagcttgcgatcgtcttctcccgccccttgccacctccccgaacacccgcccccgacgcccgacaacacccccgcccacttcaatccaggcaaatcataaatcctacccagtcggcagcatccagatgagccacaactcctttctcagcgcaaccaggccatgggagtgctccatcccctgcctcgcagttactgattctccaagccgggcgccgcccagtcctggtggggcttcccccacccctctccgcgccgggaaatcgcgcgctctttctttacctgcgctccactggtgggcagcgtatgctcccgcgtcgacagctctgtttcgccttccggtccccatagctctgcaggggaacaggatcgctggcgcctcctgggccgctaagcgaccccggggctgcccggcttagcgagtgcttcgcagagaggtagccgagtcgaggcagcgcggttcccaaggaagtcacggctgcggccaccctccagttcggacctccgggcagccgcggttgctttcagtctctgcccattgagacaaaagagcgtgacaagccgcgcgacgcggccaatcagcggggcgaggaggcggcctccccaagcagcctctggccctgaagctactgctagcaagactcgggagctggctggcgggggctgaggccgacaggcacgggagccggcgcggcgtcaagtggagctcggacgcacggaccaggcccatttccctttcatctgttgtagttctagcagtgagaacttctcactgaatgccacagaaattaaagacacagttgttggaggtatgatgtcagacagcatttgtcaccaaggttggcagaaaatggctagtccaggagagttgaaaatgagcttccacatctgcaaatcgggatgtgttggaacagtactcaacttgtggattcaaggaagtatgaacacagagtctgcataaggaaaggaaaaagatgcatttatctcctaattacactggtgatttccacttatgtcactctgtacatccatgtccctttcttcattttaacttcttatttaaaaataatttcaaacatttaaaaatgttgcaagcataaataaagcttaaagaacacccatgtcccctttaccctaattcccctattattaatgtttctccccatttgctttattatttaagtgtgcactctgtctatacacacacaggatattttttccctgaactgtgaattgcatacatcaattttcagtattcctcgattcaatgtttgcaaatccaaattcttttaaaaaagactgtgttttatctctatgacaatggaaccgttattgcagaatattataaaatgaaaagtcacatggtatatgtgatactgtgaaatatatatttgctcttcgatcctgtttcctggcatgcaactcttaaaatccttagaatttccaaagtgatatctttttgtatgctaataattgactgatggctggcagcctctggttgcttcaggatgggaactagtcaccagagagaccaaggcgccattagagggttgggacttaacagcctcattcccgacctccagggaggggagaggggtggaaggttaagtcgatcaccagtggccaatgatttaatcaatcatacctatgtaatggagcttccataaaatccccaaggaactgggtttggttagcttccagatagctgaatatatggaggttcctggagggtggtgacccaaggagggcatggaagctctgagccccttccccagtacctcaccctatgcatctcttcatctctatcctttgcaatatcctttataataaactggtcaacgttaggtatttccctgagttctgtgagcctttctgacaaattaatcaaacccaaagagggggtcatgtgaaccgaaacttgaagcccatctgtcagaagttctggaggactggatttgcgactggtgtctgaagggcctgggaacagtcttgtgagacctagtcctcagcttgtgggatatgacgctatctccaggtagatttgtgtcagaattgaat

SEQ ID NO: 466654 - DNA, 1080 bp, Homo sapiens
acatgcgtgggcagagtcacaacacagatgctcacccgcacacagaggcatgtgcaccagctccctgcacactcgtgcctggcgtgctcagaggaccacccatgctgctcagggagacagggcttgctcactaatgtccggctgtcatttctccacctaagagccttccatggctccctactgcctacagcattgaatcccaaaaagtcatactctttggactttgaaggttctccacccggtgccccaccctccccacagagctcttcctcattctgtctctgttccctgctttggccagtggctatcctcaatgtgacccacactacacttctgcccacactgcagctctttacccagttaccctccagttcctcacaacggcaagccccaatccctgcttcatttttgtatatgggcgctggacctacagccccactgtccagccatttggaaacaaaaacagatgctattgttcttccttagagaacgtggccagtagaaacagggcacactggaaatcagagtgaatgttcttgaaagagggtcatgggtcaaccaggccaagccaaaggatgcggtagaaccattttccttagaaatctttgggagtgaagtaggcttcagccactcccatccctgcccttgcagctaccactgcgccattagtttagacagggttagggatagagggggaggggtccagatgtggagaaaaaatcagattgcctgtggcccccaggctccttccccagctgcttctgtcctagctcaggcctgggtgccattcttacactctctcagttgtgtgctcacccccgcacacatcacacaccttgctggtcacacagtcacagcctggcctctgctcctgtggtccagtggctggacaccccctgggatggctcaaaggagtcaggacttggaagtggggacatccgggtagctgaaggaaatccacacacccagactctcagacctgaggtaggctccccaggggctgggataggagttggacggaatggaggatggaggacagtgagaagaagaaaggaagagaaatgcaaagtgtggcagccg

SEQ ID NO: 466655 - DNA, 1192 bp, Homo sapiens
tgtaggtggcccagttctcgccatgccacttcacattttcttccctgaacacatgtctctgtgtctgaatttccccttttgccgtctggggtttggggcaattctggaccttgtgaaatctactttccgcccctttgaagacacctcaggcatccttggttgtgtcataatcttggtgaaacttactggaacgatacctttactttacagaaaacaaaacaaacaagaaaaggtcaaaacccagaaatatcagctgcttgtcttctgctgctgcttgtgggccatagtggcatcggccgctttccgctccttcgtgctcaggcctttgtcagaggtcgtctcagaggaaggcttaaccatctcagaggcaactgccagtggatggcgagctctgcattccacgcattcttccactcctgttctgcgaccactccagttccaaaaaagctcggtggtactacgaatcctctctaaatcatactcctcatctgtttattccttatttcttcctccaggagcccactttctcttgagaaagctgcagatcctcgttcagcatggtgcaccagggttcccaaagacctgatgtgtgaggcttctttgccttttcataggtcttggctcaaatcctgactcccctgtgaagatgtcctgaccctcccagcctagagccactactccctccttgaatctcaggatctccaactgtgacatggccatactatttgccacatccccacagacggattgtgatgaggaaggaaagagagagtccatgtagcatgctagatgcggtgtctggtgcaggcctgtgggctcccctaaaatgtggcactccaatgacaatccatccctctctatggagcctacgacagcacacacctcagcgttctagagaggacaggtttcaggccaccggaggaatttagggagtgactacaggagcgaccttatcccacactgtttgaacaagcactgtgggccaatggccatggactgagccagtggaaagtggggcttggacccctctgattggacgtttccatcatcccaacgatgcgttagttccaagtcatgaaggtgggtatttccagaaataaaacaatataacctggaaaagaacagacagaatcagatacattagaagtagttggagtaataacttcagtttctagggagcttggagaggtat

SEQ ID NO: 466656 - DNA, 1580 bp, Homo sapiens
actctttgtcaagaaacaaagatcttgtattcatgtaaatgagtttaattatacagcttgctgttgaaaagtctgtggttaaggatacttatagaatccagtttggtttttctttcaatttctcacttttgcagttatgaatatagacaattaggcatttggttaaatggaaagagagagcagttgctgaactaggtgagggagaactaagcatactgagactgtagagtatcagttgtctctggataatccaagaagatggtcatcaaatctaggctgaggactaccacaaagactcccactgccaagaattaaggaacaggtggagactaatattgactcctcacaaatcccaggctgactcaacagcagagaaaacagcagacaatgtctcttctagcaccccgttctgtgtgatcaccaatcgccctctgcctagcactgccaatggggttacagctactcctgtgctctccattactggaacagattcctctgtggaagccagggagaagaggaggtcctatctgactcctgtacaggataaggaagcagagttttaaggacagcacgctccagacaagctcggcagacacgaaggtctactcaaggtgtcaccctagcagaccttcaagaagcagaaaggacattcagccagtcgagggcagagaggcaagctcaggagcagcctcgtgagaagcctacagacactgaagggcttgaggggagccctgagaagcatgagacctaagcagttcctgcaacagaagctggggagggccagcagccctggggcaggagtctggatgaagaggcctgacatccaactcttccctgcagtgaaaggcctaagttcagcttttctgaagacactcgaggctcctgtaaaatcctaagtctgattcgttttcctctctctctggggctcgattgcttaatatggtaagagactgtgtgtatatcgcgagtcggaggccaaacacaccgtatttcatctgtagcattcaagacttcaaactgtttactgaagctgtaagggaaaaagatgagcagaaggaaataagctttgtttctctgacagttccagaagttagcggggtttggtggaagggtattttggcaccagcagagagcatgctgggctgctgcaaggagcaggagctggcaatcaacagcgagtttggatgttggcaactgaaatggggagaaaaggggatgagccatcttgcagaccactgcttaagaagactgactgtggcagtttgcagtgtggaagggggaaagatggtgaaagctccaagtaggaggctagggctgccattcgtggggatgtttgtggaggatatgtcgcagaaagaaactactcgctttaccagcatccaagatgaggctcatgtccagtgctctagcctcatatctcaggcccaccccttattccagagtaaatagtattttattcaagttgcccatattttcaagttctgtcttggttcagagctttctccctttgctttttcccatactgttttctgttagtcttctcagagctgacactttcttcttttcaggtcttagattac

SEQ ID NO: 466657 - DNA, 2805 bp, Homo sapiens
ccgtggaggaaggcagacttcagactgaaggacagagaaggcaactgccctacagccctgcaggtcttcaagtctgtggttgtgggcactaacccagacaagaaaaggaaagacctgcagtatcggtgcaggaaaggcaaagaagggaacatctcaacatggaaaagctctacaaagaaaatgaaggaaagccagagaatgaaagaaacctagaaagtgagggaaagccagaggatgagggaagtacagaagatgaaggaaagtcagacgaggaagaaaagccggacatggaggggaagacagaatgcgagggaaagcgagaggatgagggagagccaggtgatgagggacaactggaagatgagggaaaccaggaaaagcagggcaagtctgaaggtgaggacaagccacaaagtgagggcaagccagcctcccaggccaagccagagagccagccgcgggccgccgaaaagcgcccggctgaagattatgtgccccggaaagcaaaaagaaaaaccgacagggggacggacgattcccccaaggactctcaggaggacttacaagaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggccaacggggtgtgaggggagtgaggggcggaggtaggggccagaaagacttagaagatgtcccatatgtttaatgtctttggcctttaattctgatttctctgatgggaatattgccagtcctgcttttcctggcaggcatttgccggcctatgtgctttaaccttaagctgatactttcctttaggtgtcactcttgttaccagcagacttttgacccaactacagtgctctgtcttttagtagaggattttcacccatgtgcatggaataaatgttcatggtacattgtaaaataacaataaaaaagagttttcagaaccatgtatacagtatcagcccatttctgaaaaaaaatgtttacataatatatccatacatgggggacactatgcaattgagtagatcaaagagaaatcatgaatttctttgtgtggtgggactgaaaattattctttttctcatctgtacttcttttaaatctaaaaagcacaggctatttttgttttaaaggaagtaataaaagaagaaataaatgactcttaaaacccaataatagaaaagcaaaccccaaaaaaggctacgggaagtaaagatatgaacagagacttcattaaagtatatattcagacaacagatatgcacgtgaaaagatgcttagcatcggcgaagataacagtttattgtctccgattggcaaatacgaaaaaagattgacagtatcaagtggagggaacgcagcgggcgggctgcagtgttaatgggaggggtaactggggactcgagctcagtgatgacgcgactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagatacacacgtttaagactcagtcttttcatggggaaaatatttgcttcacagggctgcagtggggaagaaatgaggcagtaacagctgtgct

SEQ ID NO: 466658 - DNA, 2112 bp, Homo sapiens
tcaaggttgagaaagatttagatttaaagggactggaacaaattttattcgtcagttaaaaacaattgaaagaaaataaaatctgaaaaactttgaataggtagtaaaagatgatgaattcttagagctttacctcagaatgtgtaattttcatgcttttcctttctagaaatctaggaaacctgacatgggacctttggtaaatacattattattcatacattttgatggaatataactaatatgtttattttctctaaaccatagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctataggtaattttgttggcacttttagattatatatttaattgaattagaaaattttaagaattctgtttatctgataatgggcagagtttaatgatagagcttgtg

SEQ ID NO: 466659 - DNA, 735 bp, Homo sapiens
gaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctataggtaattttgttggcacttttagattatatatttaattgaattagaaaattttaagaattctgtttatctgataatgggcagagtttaatgatagagcttgtg

SEQ ID NO: 466660 - DNA, 608 bp, Homo sapiens
gctggtctgggtgcaaattaaggccagtgttggggtctgagtgctgtccagaaaggctgtgtgaccaaccctcactagttcctgaggtcagggtctccatgttagggaacagagcaagagacttggaacagctccctacagctgcacttctagaaggtcagcctgtccgattcttgtaacctggaggtccctccccatctgcagccccctgagctgcaggagcggccccatcagtgcacctgattggaacacactagatttcaggtcctggaaactgggcgctaggatccgtttccctggctgcagagagtgggaggtgtgatgtggaatatcccttctcccagcacaccccaattaatactgaagagtagggcaggaggaggtgctgggaaaaccgggtttcttggcacatgggggtgcaagcactgtggttgaaattggccatgtccaaggcacaccagacgatttcaggtcatttttagccctagactggaaaggggtcaggggacaggtgacctgggctcagcccccagcagctcccaactgcccctctcccaagcaactcctgatccctgcttttgaggaaataaacaaataaaaccccgcta

SEQ ID NO: 466661 - DNA, 968 bp, Homo sapiens
  misc_feature (968)..(968): n is a, c, g, or t
gctggtctgggtgcaaattaaggccagtgttggggtctgagtgctgtccagaaaggctgtgtgaccaaccctcactagttcctgaggtcagggtctccatgttagggaacagagcaagagacttggaacagctccctacagctgcacttctagaaggtcagcctgtccgattcttgtaacctggaggtccctccccatctgcagccccctgagctgcaggagcggccccatcagtgcacctgattggaacacactagatttcaggtcctggaaactgggcgctaggatccgtttccctggctgcagagagtgggaggtgtgatgtggaatatcccttctcccagcacaccccaattaatactgaagagtagggcaggaggaggtgctgggaaaaccgggtttcttggcacatgggggtgcaagcactgtggttgaaattggccatgtccaaggcacaccagacgatttcaggtcatttttagccctagactggaaaggggtcaggggacaggtgacctgggctcagcccccagcagctcccaactgcccctctcccaagcaactcctgatccctgcttttgaggaaataaacaaataaaaccccgctaaaaaaaaaaaaaaacctcgggttttggtttgtttttttttaaaaaggggttcaatcgggggttaacaccccgtgtaacaggtgtgttgtctccccaaggggagaggggacgaggctccctttgtggtatgacaaatctattcggcaaccacggggttgttcacccacacgaggggcccagggagatggcctgggacaaaacacaactttttgccccgcgggaaacgggcaacttcttaatccccgcgacaatgagtttctcaccacaagtgttggtgtgcaccaggaaaccgtgtctctgtgaccccgttagttcagactgtcgttaaaagacggcgtcccaattactggacttataacn

SEQ ID NO: 466662 - DNA, 464 bp, Homo sapiens
aatatgtcaagtgcggcggttaatcggaggggctgatctgtactgaggtccgcgcatctaagccactagctgcaggagcggccccatcagtgcacctgattggaacacactagatttcaggtcctggaaactgggcgctaggatccgtttccctggctgcagagagtgggaggtgtgatgtggaatatcccttctcccagcacaccccaattaatactgaagagtagggcaggaggaggtgctgggaaaaccgggtttcttggcacatgggggtgcaagcactgtggttgaaattggccatgtccaaggcacaccagacgatttcaggtcatttttagccctagactggaaaggggtcaggggacaggtgacctgggctcagcccccagcagctcccaactgcccctctcccaagcaactcctgatccctgcttttgaggaaataaacaaataaaaccccgcta

SEQ ID NO: 466663 - DNA, 3360 bp, Homo sapiens
gctggtctgggtgcaaattaaggccagtgttggggtctgagtgctgtccagaaaggctgtgtgaccaaccctcactagttcctgaggtcagggtctccatgttagggaacagagcaagagacttggaacagctccctacagctgcacttctagaaggtcagcctgtccgattcttgtaacctggaggtccctccccatctgcagccccctgagctgcaggagcggccccatcagtgcacctgattggaacacactagatttcaggtcctggaaactgggcgctaggatccgtttccctggctgcagagagtgggaggtgtgatgtggaatatcccttctcccagcacaccccaattaatactgaagagtagggcaggaggaggtgctgggaaaaccgggtttcttggcacatgggggtgcaagcactgtggttgaaattggccatgtccaaggcacaccagacgatttcaggtcatttttagccctagactggaaaggggtcaggggacaggtgacctgggctcagcccccagcagctcccaactgcccctctcccaagcaactcctgatccctgcttttgaggaaataaacaaataaaaccccgctactccgaagatttttctttaatgaaaaggattcgtttttccaaattctatttccaaagccgaggagattgccgggctggagcgcatcgttggtgacgcttgcccgtcggaccctggcagcggctggaggaggctcagcccatcggtccgtccggaggggcttgcgggaggggttggtttgtttgggatttaggggttggttgaggatttgttttgtttaggtagggagtattggggtgataagttagaacaactgcgaaacgagttagcgggcgcattcggccggcctcttctttcacccccgacttcatgcggcttgggctgagggcggaccacattcggccccgccgctgcgtgccggcttcgttccggccgaaatttgaaaggaggaaaaacgacgcgatcgactgaaggaccctgccggccgggactggtcacccgcagagaaggaagaaggacgaggatgcggatggcggcgctggtggcagggaccggcgtctctgtgcgcgcgggccgggaccgcgatcctcgcgctggggccagccagccgccgccccgagaggtctcgcccgcgctgagccctgtccctggggcccccgcccctgttgcgcccggagctcagccacagatgtccagccacaattctcggttggccgcagactcgtacaagaattgccgccagtccaggacagctcggagctgcgcgtcggaccacctagcaggcgctcagcagcggctgcccatccggcgcacgcggatcctgaccctgtgcggggatccccatcgcccctggcgtggctccttcgatcgcggcccggagtccgcagagtggcccgcgttgggtctcagcgccgccccaggtcgagggggaatctcctctgtctggcctggggaaccccgactcccctctccctgcccccagcctgggatctccgggaatccggaaggcaggagccccaggccgggtcgcgtttccgagcccggggtccgggctgctggattcgtgggtcccccgcccccgcccagccccgcgcacgcaccggctcgggcgctctccgctttcctgtggctgagtcgcggccggggcgcctgcggtggcggtggcggcggtggcccgggcggcggggagtgctggaatgcgccgccgggtcacctgcagcgcccgtggagccggactgggagccggcgggctgccgaggcgcaaggctgaacccgagcaggcgcctctggcggctcggggccggggcgggcttttagtgggccgctccaacaatacgggcctggcgcggagaaaggggctcggctgcaattggtactggatttgaataacgccacggggccatcaatggtcattgtgtcggcgggtaatgaatctccgctgtctctcgggctggccaggcagctgcaacctgcgctcaggcagctcttaaagacatagcgtgcccctccccgggggccgcctccccctctgcaccggccggacccctcgtcctcccacccccactcggcaccctcaactcccgatgccccgcctgctccctcggcctgacccctttgcccatcgccccctcccttctcctgggccaggcaccagcatcccggccctgctctcccgtggacctgactcaggccccggccttggctgagctctccaagagcacccagggcaccccagagtcttttacggcccaccccctgtctcccagctgcatggaaaccaaaggcctctggagccccctccctaggcccctgcccaggggcttccactggagggtgagggggaacagtctggaagtcagagggtcaccccctgagaagaccatgctgaaggataaaggagaagggggtacagtccccacccctgggctgaggatgccatccctggagaccacaccccacgcgggagctggagcctgccccctcccccgaccaaggaccagagcttgattcccaggctccagcaggctcctgggtacctcggggctagcagcaagggtggggggaggggagcaggtgggtgtgagaggggcgtggaatctgtgaatgcttgtcttgtcattgtctcttccattggacagtccacccatccaggagagcaggggctctgtccaaggtctaatgcgcccccagccccacccccagcctggtctggcagagacggttctcagtctattgggtaaatacatagccagcttctcacccccaaagcccagcctgtctttcccaatgaacctcacaccctaaagtgggagtgtgtggccatttttcccatacagcctgccttccattcaccccagagttctccaagcacccagaatacccctgcctctgtcctggcacaccaagctgccttgctctgaaatgctctcctgtcctcacaatctctgggtggccttgccacgtgcccggctgaattgtgaatatcggtttgtctgagtctcctccctaggacaggaaacgggtcctacggatctttgtgcctccagggcctagtacagtgccctccccccaaccaatcattaaatatctgtgggtggttgcacgcatgcccggtgactttaaaatgagccacatagacttcttggagtttcttataaaagttgaaagaatgttgcttgtgggaggtaattcttgcagcccgggttttacagggagggagtcctgctaaccagatcccaactcctgggaatgctccatttggtaataataacagcaaagagtgtattgtgtgccaagcactaagctctttgaagg

SEQ ID NO: 466664 - DNA, 1639 bp, Homo sapiens
tcacatgagcgaaccatgtggtctactatgctggttgactccaaaacgggaactggctgagtgcagatacagcctgccaggttcttctaccctggtgttgaagaaccggtctggctttgtgcgcatggcccttcagcatggggtgcctctaatacctgcctatgcctttggggagacggacctctatgatcagcacattttcactcctggtggctttgtcaaccgcttccagaagtggttccagagcatggtacacatctacccttgtgctttctatggacgtggcttcaccaagaactcctggggccttctgccctatagtcggcctgtaaccaccatcgtcggggagcctctaccaatgcccaagattgagaatccaagccaggagatcgtggctaaatatcacacactctatattgatgccctacgtaaactgtttgaccagcataagaccaagtttggtatctcagagacccaggagctggagataatttgacagacatccccagtagccttcaccctggctggaagctcttttctgccctttctttgcagctactggtgagatagtcccaagaaacagggaagagcctaggggagaggtgccctgacggcactttggtgccagcattgaggaaaacaatggacaaaataaaaagcccatcttctgataactgcgtgtgcaccaactactctgttttgaaggctctgggatgcatgtctctccttctctagctgtcaaacagccccatctcccggcattgagccccatcttctggcattgagtcctgcttcctacaggagtaggactggggccttgagagccagtgggctttgagtttaagctccaccaacttcaagccatgtgactttggggcaatcagtcacctctgagcctcctttcttcttctataaaatgagactaacaatctgtctcttgcttacctcaaaggccgttgggaagatcaaacaatattggatgtgattgaactttataaactggagagctacaccattttcttctccaaccattttacccatttcctgtccctgagcaaacaacgcccgaaataccctctgctacccactagccctcactcagtttctgcctcacaaagctgtaacagaatgggttgggctcaggcctaattttctctgtcattccctcagcaacttgcctatacttgtgtggccctataattctggcctttgtttgagagtcagccagcctgctcaggatgaaaatgaggcgcctggcttttagcagccataaagaactctccttctgaatggcaagtctctcagactcttggtctaatggctgttgcaatgacaggctacaaaatttggctcacatccctctcattccatccctcttgggtgggtgccatttggtccagtgatttacctgcattacgttggtcaatttggtctacaacatcctgcgtgtttactgcagtgtgagctgctgcctctatcctgggtgcctgcctcatgtgatgatttgtatacagtggccaaagacatgcttctgcttttctgctgtctttgttacttcttgtgccagagattacgttttccctgagcttccataaagtgtttttaaacagtctgtagctttcctgtgactggtttcctt

SEQ ID NO: 466665 - DNA, 931 bp, Homo sapiens
  misc_feature (11)..(13): n is a, c, g, or t
  misc_feature (15)..(15): n is a, c, g, or t
tcctccttttnnnanccctgtgcctcatccctgcctcttgtggcacctgatgcctccaaattctgagtctttcctagatcctccagtgcaaataggctcacatcttgtaggcatcccccttgcagcaaccactgtgattgctgtcaacctctacctggtggtgttcacaccatactggcctgtcactgtgcttattcttacctggctggcttttgactggaagacccctcagcgaggccaggaaacagcagggggtgagagcaccctggggcaggcccacagtgggaatggacaaagcttggctgcattgcctctgttttcaggcggccgccggtttacctgtgtgaggcactggcgcctgtggaaacactacagcgattatttccctctcaagcttctgaagactcatgacatctgccccagccgcaactacatcctcgtctgccaccctcatgggctctttgcccatggatggtttggccactttgccacagaggcctcaggcttctccaagatatttcctggcatcaccccttacatactcacactgggagcctttttctggatgcctttcctcagagaatatgtaatgtctacaggggcctgctctgtgagtcgatcctccattgactttctgctgactcataaaggcacaggcaacatggtcattgtggtgattggtggactggctgagtgcagatacagcctgccaggttcttctaccctggtgttgaagaaccggtctggctttgtgcgcatggcccttcagcatgggtaaggacagctccagtccaggctggcggaagggatccaaaagtgttgcagggaaagaagaagagggggttttgatgaaaggacatccacagagagaggaggaagtatacaatacattcttacgaactatggtcatcagaaagataagttttatttg

SEQ ID NO: 466666 - DNA, 2444 bp, Homo sapiens
  misc_feature (11)..(13): n is a, c, g, or t
  misc_feature (15)..(15): n is a, c, g, or t
tcctccttttnnnanccctgtgcctcatccctgcctcttgtggcacctgatgcctccaaattctgagtctttcctagatcctccagtgcaaataggctcacatcttgtaggcatcccccttgcagcaaccactgtgattgctgtcaacctctacctggtggtgttcacaccatactggcctgtcactgtgcttattcttacctggctggcttttgactggaagacccctcagcgaggccaggaaacagcagggggtgagagcaccctggggcaggcccacagtgggaatggacaaagcttggctgcattgcctctgttttcaggcggccgccggtttacctgtgtgaggcactggcgcctgtggaaacactacagcgattatttccctctcaagcttctgaagactcatgacatctgccccagccgcaactacatcctcgtctgccaccctcatgggctctttgcccatggatggtttggccactttgccacagaggcctcaggcttctccaagatatttcctggcatcaccccttacatactcacactgggagcctttttctggatgcctttcctcagagaatatgtaatgtctacaggggcctgctctgtgagtcgatcctccattgactttctgctgactcataaaggcacaggcaacatggtcattgtggtgattggtggactggctgagtgcagatacagcctgccaggttcttctaccctggtgttgaagaaccggtctggctttgtgcgcatggcccttcagcatgggcagccaggggtaggccatggagcccccacactcaacttggacctaggcacagctggactggggtctgagaagcctgtaggcagacccagggatcatgcgccgtcagcgtgtctggcattcgacaaggtccctacctttctgggcttcagaagatatgcttttgctctgcagggtgcctctaatacctgcctatgcctttggggagacggacctctatgatcagcacattttcactcctggtggctttgtcaaccgcttccagaagtggttccagagcatggtacacatctacccttgtgctttctatggacgtggcttcaccaagaactcctggggccttctgccctatagtcggcctgtaaccaccatcgtcggggagcctctaccaatgcccaagattgagaatccaagccaggagatcgtggctaaatatcacacactctatattgatgccctacgtaaactgtttgaccagcataagaccaagtttggtatctcagagacccaggagctggagataatttgacagacatccccagtagccttcaccctggctggaagctcttttctgccctttctttgcagctactggtgagatagtcccaagaaacagggaagagcctaggggagaggtgccctgacggcactttggtgccagcattgaggaaaacaatggacaaaataaaaagcccatcttctgataactgcgtgtgcaccaactactctgttttgaaggctctgggatgcatgtctctccttctctagctgtcaaacagccccatctcccggcattgagccccatcttctggcattgagtcctgcttcctacaggagtaggactggggccttgagagccagtgggctttgagtttaagctccaccaacttcaagccatgtgactttggggcaatcagtcacctctgagcctcctttcttcttctataaaatgagactaacaatctgtctcttgcttacctcaaaggccgttgggaagatcaaacaatattggatgtgattgaactttataaactggagagctacaccattttcttctccaaccattttacccatttcctgtccctgagcaaacaacgcccgaaataccctctgctacccactagccctcactcagtttctgcctcacaaagctgtaacagaatgggttgggctcaggcctaattttctctgtcattccctcagcaacttgcctatacttgtgtggccctataattctggcctttgtttgagagtcagccagcctgctcaggatgaaaatgaggcgcctggcttttagcagccataaagaactctccttctgaatggcaagtctctcagactcttggtctaatggctgttgcaatgacaggctacaaaatttggctcacatccctctcattccatccctcttgggtgggtgccatttggtccagtgatttacctgcattacgttggtcaatttggtctacaacatcctgcgtgtttactgcagtgtgagctgctgcctctatcctgggtgcctgcctcatgtgatgatttgtatacagtggccaaagacatgcttctgcttttctgctgtctttgttacttcttgtgccagagattacgttttccctgagcttccataaagtgtttttaaacagtctgtagctttcctgtgactggtttcctt

SEQ ID NO: 466667 - DNA, 1279 bp, Homo sapiens
  misc_feature (11)..(13): n is a, c, g, or t
  misc_feature (15)..(15): n is a, c, g, or t
tcctccttttnnnanccctgtgcctcatccctgcctcttgtggcacctgatgcctccaaattctgagtctttcctagatcctccagtgcaaataggctcacatcttgtaggcatcccccttgcagcaaccactgtgattgctgtcaacctctacctggtggtgttcacaccatactggcctgtcactgtgcttattcttacctggctggcttttgactggaagacccctcagcgaggccaggaaacagcagggggtgagagcaccctggggcaggcccacagtgggaatggacaaagcttggctgcattgcctctgttttcaggcggccgccggtttacctgtgtgaggcactggcgcctgtggaaacactacagcgattatttccctctcaagcttctgaagactcatgacatctgccccagccgcaactacatcctcgtctgccaccctcatgggctctttgcccatggatggtttggccactttgccacagaggcctcaggcttctccaagatatttcctggcatcaccccttacatactcacactgggagcctttttctggatgcctttcctcagagaatatgtaatgtctacaggggcctgctctgtgagtcgatcctccattgactttctgctgactcataaaggcacaggcaacatggtcattgtggtgattggtggactggctgagtgcagatacagcctgccaggttcttctaccctggtgttgaagaaccggtctggctttgtgcgcatggcccttcagcatggggtgcctctaatacctgcctatgcctttggggagacggacctctatgatcagcacattttcactcctggtggctttgtcaaccgcttccagaagtggttccagagcatggtacacatctacccttgtgctttctatggacgtggcttcaccaagaactcctggggccttctgccctatagtcggcctgtaaccaccatcgtcggggagcctctaccaatgcccaagattgagaatccaagccaggagatcgtggctaaatatcacacactctatattgatgccctacgtaaactgtttgaccagcataagaccaagtttggtatctcagagacccaggagctggagataatttgacagacatccccagtagccttcaccctggctggaagtcatcagctattgttagtgttagtgtattttatgtgtggcccaagacaattcttccaatgtggcccagggaagccaaaagactggacaccctgacctaaggtaatggggatgtgg

SEQ ID NO: 466668 - DNA, 1354 bp, Homo sapiens
ccaaacatggatcctcatgattttattttctagattggctgataggctgaataatctcctgtagggtaagaagtgtcaactgtatcaagcacatggaggtggactggctacaggagaaagtgtgacgtgggtgaaggagttcttattgagccatgggaggaagaaatagtacagaagagcaaagaataataatgagtcagctagacagaagacaggagtcatcagatttgtaccctagttactcgacccatcaactgactgtggtttttgggaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggtgtgaccttctttgaggtcagccctctgtgcaatttcaacatcatagagtctttcacggagctggccaggatagtgctgctgcggcacaggatgaattggctcgggaggccgagcaaggtactgagcttgcaagacctctgctgccgcaccatcgtgtcctgcacacctgtgcatctggtggacaagctcccgctccccagtaccttaagaagccacctcaagtccttctccatggctaagggcctgaatgccaggatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacacagtttgact

SEQ ID NO: 466669 - DNA, 1339 bp, Homo sapiens
aggagattcctttgacataatccaaaaggcatggttccataacgatcacatgaaagttttaagggaaatgtataggtttccatgatgaattaactgctgtgtcactactctgtgctgggtaagaaaaaggaaaacaatcgctgaatcagtttcctagggtttgtaaaagaaatccatcaaagccaccacctcatttcgctttatttcacagacttccccatctcattttttatgttctatgctaatttctcaagaagaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggtgtgaccttctttgaggtcagccctctgtgcaatttcaacatcatagagtctttcacggagctggccaggatagtgctgctgcggcacaggatgaattggctcgggaggccgagcaaggtactgagcttgcaagacctctgctgccgcaccatcgtgtcctgcacacctgtgcatctggtggacaagctcccgctccccagtaccttaagaagccacctcaagtccttctccatggctaagggcctgaatgccaggatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacacagtttgact

SEQ ID NO: 466670 - DNA, 268 bp, Homo sapiens
attggctgataggctgaataatctcctgtagggtaagaagtgtcaactgtatcaagcacatggaggtggactggctacaggagaaaggttttccaaatcaaattccaagtatttctttctctttttatattaccattaggagaaataactaatgtagatgacgggttgatgggtgcagcaaaccaccatggcacgtgtatacctatgtaacaaacctgtacattctccacatgtatcccagaacttaaaagtataataaaaaaattta

SEQ ID NO: 466671 - DNA, 820 bp, Homo sapiens
aggagattcctttgacataatccaaaaggcatggttccataacgatcacatgaaagttttaagggaaatgtataggtttccatgatgaattaactgctgtgtcactactctgtgctgggtaagaaaaaggaaaacaatcgctgaatcagtttcctagggtttgtaaaagaaatccatcaaagccaccacctcatttcgctttatttcacagacttccccatctcattttttatgttctatgctaatttctcaagaagaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacacagtttgact

SEQ ID NO: 466672 - DNA, 1491 bp, Homo sapiens
gccatatggaaagctgtatcttctgcaggttgcttggtgtatgaaggagatgggctttgaggatctgggtcgtgatggctgctgaagcttctacttcagatttgaagggcagcagtcctaaggagacccccaacacttccatccctggtgggatatgatgcctggctcaaattggctgataggctgaataatctcctgtagggtaagaagtgtcaactgtatcaagcacatggaggtggactggctacaggagaaagtgtgacgtgggtgaaggagttcttattgagccatgggaggaagaaatagtacagaagagcaaagaataataatgagtcagctagacagaagacaggagtcatcagatttgtaccctagttactcgacccatcaactgactgtggtttttgggaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggtgtgaccttctttgaggtcagccctctgtgcaatttcaacatcatagagtctttcacggagctggccaggatagtgctgctgcggcacaggatgaattggctcgggaggccgagcaaggtactgagcttgcaagacctctgctgccgcaccatcgtgtcctgcacacctgtgcatctggtggacaagctcccgctccccagtaccttaagaagccacctcaagtccttctccatggctaagggcctgaatgccaggatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacacagtttgact

SEQ ID NO: 466673 - DNA, 1739 bp, Homo sapiens
ccttcccaccaagccagcccagccatggaagaagggaagacaggcaagtgtctttctcgcgccaagacctccccccgggcccagctgtcctgcagcaaggcaggcggtgtggagagctgcttcctttcctgcccggctcacacactcttcgtgccagactcggaaaatagctacgtcctgagctgcggagttccagggccgcagggcaaggcgctgcagaaacgcaacggcaccagctctggcctcgggcccagctgctcagggaagaccttcctgctctcggccctgctccgtgtggcctggggtgctggcgatgagccaggcccaggacctagaagccagcaggctgcaggccgagttctagcccaggatgcccccaccacccccatcaaacagaaggcccgcttcaagatccgagatgccaagtgccacctccggccccacagccaggcacgagcaaaggagaccgccaggcagccgctgctggaccactgccatgtgactttcgtgaccctcaagtgtgactcctccaagaagaggcgccgtggccgcaagtccccatccaaggaggtgtcccacatcacagcagagtttgagatcgagacaaagatggaagaggcctcagacacatgcgaagcggactgcttgcggaagcgagcagaacagagcctgcaggccgccatcaagaccctgcgcaagtccatcggccggcagcagttctatgtccaggtctcaggcactgagtacgaggtagcccagaggccagccaaggcgctggaggggcagggggcatgtggcgcaggccaggtgctacaggacagcaaatgcggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagacctcgagggcatgagaggtcctggggacagcaccccagtgctgccctttccctgcacccctccacacccaccacactgccttgtgtcccccggcagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaaaaccagcactgcggcggcgagcttggtgactacaccggctacatcgagtcccccaactaccctggcgactacccagccaacgctgaatgcgtctggcacatcgcgcctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatgaggactaccagcaactcatagaggacatcgtgcgcgatgggcgcctgtacgcctcggagaaccaccaggaaattttgaaagacaagaagctgatcaaggccctcttcgacgtgctggcgcatccccagaact

SEQ ID NO: 466674 - DNA, 997 bp, Homo sapiens
aggccctgtgggtcctatatgtgccctgcaacttggggaaaatggaggtggggttgtggtctctatgctgtagcagccggaaagccaaaaacaagccgtacttctcgctcttgacaggatcccaaggttttcagtggtggtgtcactgctgccaagctggaccgaaaacggccatcggcatgctgcccaaccagcaccatgtccaaagacctgaaaattctatgtaaagaccctgctttggagctgagctgctaccgggaccatcagttcagtggccgtaaatttcagcaggaaaaattactgaaggaaagctccacattgaatatggggaatctttccttttatacaaccgaagagaaaatacatgaactctttagtagatctgatatcaggaatatctttatgggcctggataaaataaagaaaacagcatgtggtttttgctttgtagaatgccataacagagctgatgctgaaaatgccatgcggtttctaactgggacctgcctagatgaatggattatctgcactgattgggatgtcggttttagagagggtcaacagtatggtcgcggtaaatctgggggtcaggtaagggatgagtttcgtgaagattttcattctggtagaggaggctttggaagacagactcagatctagaacaatccatagagaaaaagttttaactctaaccccttgaaaagtgtgttatagaccaacctcaagtctgcaaatagccaattccaagtttaaattaccttacttgttgatgtatttttttctctgaaaatttgttaaatagcagaaacaaaaaaaatccatttgtttttgtctgaattttgaagatgcttttcagattaccagtttgactgttaggtggtccaaagtgaagtgttcttcgggaacaaattaggtatgtaagatcagagtcaaccaaagcacaacttcccttttaagaagatttctgttggattctatggccatgttcctgcagccc

SEQ ID NO: 466675 - DNA, 1998 bp, Homo sapiens
gggcacgtaagcacacaagcagttgaacgtggaaggcgttgggagccagataatacaagatgtggactcttgtggctggaacagctgggtggccttggctttgcagggtatgttcccggcccacagggggctctccatggatctgaggagactggcagggcaggatcggaatcggcaccctggagaagctgtcgttggagacggccttggcgagacagtgtgttgcagctccagctctgtccgctgggttcagccccctcaccttacctcagtcactaacctctgtgcgctcagcgttctcagctgttaagtggacgtaacacaggttgagcatcctttatccaaaatgcttgggaccagaagtgtttccagtgttggatgttttcacatttgggaacatttgcagatacataatgaagtagcttgtggatggacccaagtctaaagatggaacgcatttgttttatatactccttgtacacatacctgaaggcaattttacatggcatttcaataattttgtgcataaaacaaagtttgtgtgaagtacttatgtgtagaattctccacttgtggcatcatgtcaatgcccaaaaagctttgggttttggagcatttcagattctggattttcggatgaggaatgctcagcctatccctaaccctgtgccaggccctgtgctgggtactcgtgatactgaaaagaatgaagctcatgtctccccaacgggttacccacggggcaaagattattacatccccatttcacagccgagaaaacagacatcctgtgctgcaggggagcggaggctttgtcctcacactcagggcctgccagtaacagccgtggaaggtcaaaagaggagccaggagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagaaggatgaggctgcaattgagcgctctcagttcaatgccacgtcagtagctgatgtggacaagcgggtgaaacggcggctactcatggagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctgtgtcaccgcggctacatcctctacgggacaacccactgcggagccgccagcctcccctctgcccttacgcccgctgtgcttccagatgtggacgagtgcagcatgagcaacgggagctgtgaccagggctgcgtcaacaccaagggcagctacgagtgcgtctgtcccccggggaggcggctccactggaacgggaaggattgcgtgggcatgctcgcagcactgggtgcccctaggctgagttctggacgggcccctgcgttccctggttccctgtacatgggaccctgtctgggtgctggggctgtgggcctgccctcctggaacctccacgccgggtccttgccccgccacactctgacatccccagggcagcctaagtgagccttttaaatcactcctcactcctcccttgctgtgagggtctgtgagtgaggcctgccccatcacccacccagagccgcagccttggccacttcc

SEQ ID NO: 466676 - DNA, 872 bp, Homo sapiens
aacttggcatttctgtaagacatgcgtagggaccctgggctcctgctgctgtgccacacggattcctctgacctccaagtggacatgcagcacctgggaagttcccaagtcctgattcgagatgccctgggcatgagtcatctgtttctgactgacttcgtctatgatgctgtgtgtggggggcagaaaagtctgtctgccatcctcagttgtccagacactttctgtaagatcctcgtcagtatcagcgaattctcttctgagggtcccctgcttttcttgatcaacagtgcctcttctaaggggcgtggaggcaccatctttggcatctgtctctataaggtcatggaaatcaccccttcttttgacttgtctctccaggagtgccggaatgtcatggctgagaaaagagatgttaacaggctgtatgatgttggccacagagtgcccccctaaagaggcctcagaagaatgaagggtaagaagctcctccatgaaatcagatggcacaaaattagaggaaaaagagtccttggcatgaggctgccaccaggagaattctgaagatgcagggcatgaatggtcaatgcctttcgttgttggggcagaggtggatgacccaccagagccacctagagataacatttccggaaaagtcttcaagacgtaaaccaggcattacccaagtcccacttcgctgtttggagcccttaacttggaccccaccaactacactgccttgaaagcctgaaatactgcctggaatatttgttgtacccaggcttttctactctcaggatcacatatgtcctcaaatccgtcttatctacagtatgtttttgccttacataaatgcagatataaaacttaaa

SEQ ID NO: 466677 - DNA, 1188 bp, Homo sapiens
tatctctcagttttttaaaatctatgccggacgagcatctctggcaggcatcagggcagtgcttacacctccagagtcagggagctcactacctcctgcaacagcttctaccttgcagaccggcactcctacccctgaacgttcattggccccatggcttcccctcactggggatgctgaagaccctgcagaagagccggcaccaccaggctggcaaattctcgctgtgcctggtgccctcccaaggacgccagagagctagttttcagaaattgtacactggctccgtggaggcagaactagacattgacgagtgtgagaatgactactacaatgggggctgtgtccacgagtgcatcaacatcccggggaactacaggtgtacctgctttgatggcttcatgctggcacacgatggacacaactgcctggagacagggtcttgctatattgcccaggcctctggaactcctgggctcaggtgatctgcccacctcgacctcccaaagtgctgggattacaggcttgacccgccaccttacctcaggcattacttcaggaatgcttcacaaaagtggaaccactggatcaaacgaccatttggttttttatggctttctaaaagggctcagcaaagcttctgttgtgccagctggtttgtgggtgtgtggtagaggatactgggtgtcctgagtgctctggaactttccctcttaatggggtgttagccttagacctgcctgcctgtttttgtccaacccatgttggatgtcagataagtttgttgtggaaaacatctgtgagcatgtaattacaccccgaataaatacccaagtagaggtccgagcatcaggttattgaagcccagagaggcctgtgaagagctacccatggatgcacccaccaagcttcagttcccctaactgtgaaatgggtcagtaatacttgtctcggaggtctccaccactccctattacttgcatccagctttggccatttaactacctgcttgaaattgtgctgcctggaaatgtttggaattctttgtgctgcctgacaaagcttcctgcacaaggttttgtccccagtgggcatttggtggctaatttgtcttgtttacctttctgtctttcttcttggaacctagtgcagtgtcagatatattgtaggcatttagtaaatatttgt

SEQ ID NO: 466678 - DNA, 1061 bp, Homo sapiens
tatctctcagttttttaaaatctatgccggacgagcatctctggcaggcatcagggcagtgcttacacctccagagtcagggagctcactacctcctgcaacagcttctaccttgcagaccggcactcctacccctgaacgttcattggccccatggcttcccctcactggggatgctgaagaccctgcagaagagccggcaccaccaggctggcaaattctcgctgtgcctggtgccctcccaaggacgccagagagctagttttcagaaattgtacactggctccgtggaggcagaactagacattgacgagtgtgagaatgactactacaatgggggctgtgtccacgagtgcatcaacatcccggggaactacaggtgtacctgctttgatggcttcatgctggcacacgatggacacaactgcctgggaatgcttcacaaaagtggaaccactggatcaaacgaccatttggttttttatggctttctaaaagggctcagcaaagcttctgttgtgccagctggtttgtgggtgtgtggtagaggatactgggtgtcctgagtgctctggaactttccctcttaatggggtgttagccttagacctgcctgcctgtttttgtccaacccatgttggatgtcagataagtttgttgtggaaaacatctgtgagcatgtaattacaccccgaataaatacccaagtagaggtccgagcatcaggttattgaagcccagagaggcctgtgaagagctacccatggatgcacccaccaagcttcagttcccctaactgtgaaatgggtcagtaatacttgtctcggaggtctccaccactccctattacttgcatccagctttggccatttaactacctgcttgaaattgtgctgcctggaaatgtttggaattctttgtgctgcctgacaaagcttcctgcacaaggttttgtccccagtgggcatttggtggctaatttgtcttgtttacctttctgtctttcttcttggaacctagtgcagtgtcagatatattgtaggcatttagtaaatatttgt

SEQ ID NO: 466679 - DNA, 3493 bp, Homo sapiens
actcagttgccttaggaagccatgctattcaaaccatggagaatatcctctgttttctaaacagctatactgagacagggcttagccctgactcaccttgtttggatggatattgaccacaactgcatctacttgagtgggttggggttgtttatgctgtactttttctatgtggtattgatgctgtgtttgtcaacccttgggaaaaataatgatatccaaaagcatcagggcagagccaggaggagaaagaaaggtgggacatataaagaccggaaaagtttccagagagaagccgaagaggaaaggaagttgctttctattctgaaaagctttggacctcctgcttcctgcagtcccctgggtcagcatcatgataccacccgctttcatcgactgttatgcccagaccccgtctgtcaggtgtgtaacagagcaactgctgatatccagcgactgctgtcttgggagtccctgaaagatgctgttccctttgtgtcccctttggcttcttcagcttctgcgactgagtcatcattcactctggcttccaccccctcagcaaccactccagaagacctaatattgtccccgcagcctaagccttctctactgccccacttaattctctcccctgacctgatcaccaccttagctgacttattttcaccctcaccactgagggaccctctgccaccacagcctgtttctcccttggattccaagttccccatagaccattccctaccccaacagcttccctctccccttttcccaccgcatcacattcagagagcggagcccagtctccaacctgaggccagtttgtctctgaacactgtctttttatttgactccaccctatcccaagatatgaaccccttatcaaatatttcccaggccatgaatgccactgattcatgtgcttggcatcacgaaccaccaaacccatctgctttaccactggaggactgccctgtaactcagtctaaagcaagtcccacagtattgaagccttttccggagatgttatctctaggtaccaatgctgtattggtcagaaagtctttcaaggtccatgttcccatctccatcattcctggagattttccactcagctctgaggtaaggaagaaactagagcaacacattcgaaagaggctcatccagcgcagatggggcctgccccgcagaatccatgagtctctgtcattgctacgtcctcagagcaaaatttcagagctatctgtgtcagacagcattcatggaccgttaaatatctctttggttgagggtcagaggtgcaatgttctaaagaagtccgcatcaagcttccctagaagcttccacgagaggagctcaaatatgctttccatggagaatgtggggaattatcagggatacagccaggagactgccccaaaagatcacctattgcatgatccagagacatcttcagacgaggatctgaggtctaactctgagagagacctagaaactcatatgatgcatctgtcagggaatgactcaggggtgagactaggtcagaaacaacttgaaaatgccctgacagtacgtttgagcaagaaatttgagaaaatcaatgagggtcgaatgcctgggactgtgcatagttcatggcactcagtcaagcagacaatgtctcttcctgagaaatcccaaagccaaattaaacatcaaaatctggtagcattggtgagtgaggaccactgcgttgatacttcccaggagatttccttccttagttccaacaaacaaaagatgttggaagcccatattaaaactttccgtatgaggatgctgtggggccttccctgcaaggtccttgaatccatagaaatcttcaaatcggaagaggatatttccaattccttttcccatttctaccttccctcctcagccagctttatttctcagggagattccaaagatggggtctctaagtcttgtagacgaagcacttttcaaggagaaaagttgggaacaacaagctcagtccctgtccttaatcatcctcagcctgtctcctcacctattggcaaagaagggcaggggaccctgagaagacaattttctgatattgaccatgaccttatagagacagatgccaaagatggtgcctccacgccccttagaagaggcactacatattttcaaggagaaaaattagaaacaacaagctcattctccatcttgggtcatcctcacctcgtcacctcacctgttgatcaagaaaagcaggggaccctcagaagagaattcgctgatactgacgaggatcttacagaaagtgtctggacaactgaggatggcagacagacttttctgccccccacatacagcatcatagacgaagtcagtcagaaacagactatacttgccagtagatgcagcgcagagctgcccatactgcaagctggagttggccgtgattcaagggataagagagagagtgccagtaataatgttaacaggcttcagggcagtggaaagacctttcctgtcaccaatgggtcgaaggagatgttcaaggaagaggagatctgtactcttcaatcacaaactaggaacaacttgacaaccagcaagtcaggaagctgcttagtgacaaacgtgaaaagaagcacttctcatgaaactgaaattttcccaccaagaatatcagttcctcaaactcctaaatcatcatatcttaaaaatcagatgttgagccagttaaagttggtccagaggaagcatagccaacctcagagccatttcactggcatgtctcttgccttagataacttgagttccaaggacttactgactcatgcccagggcatctcgaatcaggacttgggaacttcccaggtgctgcatgtccacttggaggtcagaggaatccgtgtggcacagcagcaggagcacagggtccctacgcatgtcttacagaaatgccaagttaagaatttttcaccagctgcaaagagagtgagccctttaagacccaatggaggagagcttggtggaggggatgcagggttggggacatcccaactcactagaaagagcctccctgttcataacaaggcatcaggagaggtgcctgggagcaaatcttccccaaccttgaaaacacagcctccttctgaaaaccttttcagaaaatggatgcagaccttattgcagtggtttaataaacctagcataatgtgtgaagaacaagaaagttcttgggaaaagggtagctccctgtcatcatctgtgcagaatagaagtcgagttacaagtagagctgcttttactggtgctactgaagctcagaaaattaggaaagacactggggagttcctagaagaaaagctggggcatagccatgggatagatatcacctgtccctaagaacccttttccttcccagtggagcttgggaaagctcagcacaacccagaagtgcaggtcagagcagagcccttccagggctatcccc

SEQ ID NO: 466680 - DNA, 1194 bp, Homo sapiens
tggggatgatgaaaacgttctggaatgagatcgtggtgatgctgccgctagggggcagagccgtctacaccaaaagccacaccgctccagcgtgcgcgtgcggggaggtgcgcgagcgcgtgtgcacgcacggcgggggctcgcttgacgctgagtccggcgaactaagctcgccacccccaccccatccccctgctgctgggagccccaggcagtccccggccaaggcgctccaaaaggtcccctctgttgaggactgggaagcagaccccgccccagtgccccccaaagcgcccgccctcccctggtgtggctggagagggccccgcaccctccacgccgtgtctccagcatcgaaattcacagcaaaatacacaactagtgaagaactgggctcggcctgttgcgcggcagccatttgccgcgacgggatgctgctgccgctggtgtgcagcaggccgccacgcgaggaaggggacagactgccctggagacccgcccaccacggagaaaaggccacggatctaaagacaccggagggcggctacgcgggccagatggacaaatgctagagtcagcacctgtctgtgggggcgcccttggcctgggcgctggacctaggccatcaggactggagagccttcttctcttctggccagagaaagagcaaagggtggcttcctgacaggtccggagctggcacagcacaacagagcctagaaaatcactagcagggctgagctcggggttccaccgctgcagccttcctgttggacccagtctgctcaaggactccctcacagcccagtgctttctgttcaccccggggcgctcccagcccagcctcctagcctcaagccgggcacgacagctgcgggcacagggagcaatcgcctggagccagagggggcaacgccagcccaagggcaaatgggcaaccctgtgcaaaaggctctggcaaccagatcatctactttagaagaaaggagaagaaaaagagcccccaggagaggaagtagcccctaacccgactgacaagcaatccgttcgcaaagacagaagggccttcagtgaattggtttcaaagtgcttgatttcttaaaaccagaacaattgatcattagagaactgattaagctacagccgctgttgaataaaaggtaaaaataaactccttcatttgaattccaaatt

SEQ ID NO: 466681 - DNA, 5640 bp, Homo sapiens
atatacactgggccacaggttaccctcggcaatgcccacagctgtcagcctgagcctccccaggagagcaaggctcacacgacaaaggctgcccgtggccagtgaggtggctgagcccagccaggacctttctcggactcccgggatgtggctctgctcgtgagctgcctggtcagctctctcggggtgagaggggcttgtcacacgggcgcctgcctgcagtgtgacccttctcagcttctctcagcagccctgcctgcggagtgtcaccgccaccatgatcatttccctgacactgcgagggtggggggacgtcctgggtagagacagggcccgtggcagcagcaggctcaggggagccctgcactggtggactggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcagcagccctggcctggacatgactgtgctcatgcagactgaggcctgccagtccatggacggctgcggcgtagggtggcaggcacaatctccaggggcagatgaaggtgcttcactgagctgcaccgaacagctcttggccccttgaaatctctgcagtctccttgtctccctctgctggaatattcttctctcacttcatctgatcattgccttcaaaactcagctcattttcttatttccttgccctttccatgtcccttgttttcctctgattaaattaatgttccaaactcaaaagaaaaacaactcagctcaggcatcacctttcctggaaggcttccctagtcctcctgcctcccgcagacttgtctggcaccctgtgcatttgggatttggcacactatgtctcgtctgcggcctccactggacgatgagacctgttcttggggaagatcccgactaagccattttccagtggcacctcttccaccatgagttcctgaggcagtccgatggggctactttattccagaacaatcacagtgagacctcttctcccgataaatgccccttttctctccttaatatattatcttgcttacaaaacactgcagacaaggggcctgacacatgaactctcatgagttactgaggagtttctcagtgctctgtctgcatcatctgctcgctctctccttcctaggtgctagcctgccaacctgctttgagaaattggaaatgaatcggggggtaatcagcctccccttgtacatgtagggaccgcatctccaatgccttgctttacacaataacgaatggtgttttgcttacctacttccacacaaactgctgatatggttaggatttgggaaaggggaagaagggaattttgggttttgaggagtagctggggcttgaacaaagaagaggcatgagccagtgtccagcccaaaatagtcttttgattttttttccccaaccatttaaaagttcaaaacattcttagtttttgggccgaaaaaaaacaagtgatgggtcagatttagccctggattgtggtttgttgacccctgtcatagaggaacaggaagcagagaggactggttatagggcctgggaaaccaagccagggagttagacttaaggtagtgtgaaagaggaaaccatttttgtaatgtaatgaaaaatttaaaggaaggatattttgtatttatatgtgttcctggaaaatctcagtttttattcaaacattttcactatggaaaatttcaaacatttacaaagtagagagaaaaatgtaatgaaataccaagtgatgtatttatcacctaccttcaacaattaccagtcctaggtcctttgcatttctgttttagaatcaacttgtcacattctacaaaaaagctggctggaatttctgtcgggattgttttgagtctgcagataatttcaggggaagaattgacttcttaataaaattgaattttccaaaccatgactatgttatatttctcaatttatttagtttttctttaatttttctcaacaatattttgtagttttgtgtacaaatctttccagttttttgaagggatgtggtcagatttactcctatttcatatattttgatactgtgaatttcagcttccagttattcattgctaatatataaaaatacacttggtttttgtatattaatcttgtatcctgagaccttaatgtaatttgttttcaaagcttttttgtggattccattggctattctgtcaatgttgtctgtgaataaagacagttgtacttttttcttcccactctgaatgccttttatttatttttgcttcctttactgcactggctagaacttctaagtacataatgaatagaagtgtaactgcccaatgagttcaccttgcccattgcctagacagagccgattcaccaagacgggaattgtaatagagaaagagtaattcaggcagagcctgctgggtgggagaccggagttttattattgctcaaatcagtctccctgagcatttgaggagcagagtttttaaggacagcttgtcataattttgcaaaggcagtttcagtcgtggtagaagtggatttccttgtctcatttttgatcctatggggaaaatgttcagtcttatgtcattaagtatgatattagctacagatatttcatatatgctgtttatcaagtttagtaggttctcctctatgtggagttttgtattttttaaataaggaatgaatgttgggttttgtttagtgtttttctgtgtgtattgagatgatcatatggcttttctgttttagtttacaatgttgaggacatgatctcattcctttttatggctgcatagtattccatggtgtatatgtaccacattttcttcatccagtctatcattgacaggcatttgggttggttccatgtctttgctattgtaaacagtgctgcaataaacatactgtgtgtgtatacatatgtaacaagcctgcatgttgtgcacgtgtaccctagaacttaaagtataataaaaatatatatgtatataaaataagcataccatatgcatgtgtctttacagtagaaggatttgtattcctttgagtatatacccactaatgggattgctgggttatttctggttctagatcgttgaggaatcaccatactgtcttccacaatggttgaagtaatctacatttccaccaacagtgtaaaaacattcctatttctccacagccttggcagcatctattgtttcttgactttttaatcatcgcaattgtgaatggcgtgagatggtatcatagtttcaggtttaaatctacatttaaatctttgagttgaattttgtatatgataacagtctagatttattcttctacatgtgggtgttgggcatttcctagcacagtttattgaagagattgttattccagagggtgtgttcttggtgcctaggttaaaaatgagttgactgtaaatgcgtgaatttatttctgagttctctattctgttttcatttgtttatgtctgcctgtcatttgtctgtctctctctcctgcccctttttttgacagtaccatgctgttttgatattatactatagatctgaagttactatggatttacagtatattttgtagaatattttgaaatcaggtagtgtgatgcctccagcttttctttttattcaagattcttttgtctctttgaggtgttttgcatttccatgtgaattttagaatctttttttctatttccatgaaaaatgtctttgtagtttaacatagattgcactgattctgtagatcacattgagtgatagagatattttaacaatattcttctagtgcatggacgtgggatatctttccatttacttgtgtctgctttaatatctttgatctatgttttatagttttcattgtaggatctttcttggttatgtttatccctaggtatcattattttggagggcgggagtgggtagctactgtaattaaacagctttcttgattttttttaatgtgtttcactgttggttcatgtgtgtgctactcatttttgtatattgatattgtatcttgcaactttactaaatttattatttctagtagttttttttgtagaatctttagggttctctctctaggtatatatgatcatgtcacttgcaaacagaagcaatttgactttttttcccccaaatttggatgggttttattgcattctgctgtctaattgctctagctaggacttccattaccacgatgaataaaagtggtaaaattagccacactttaacaagatcctagaggaagagcttttaatttttccccattgattacgatgttagctgtgggtttgtcatatatggcctttattgtgctatgtttcttttgtactcattttgaatttttatcatgaaagaatgttgaatttttttttcagcatctactgaaatgattaaatggtttttgttcttgattcgctgaatgtgatgtatgacatttatttgtgtttattgaatcattctcgtattcctccaatgaatctccaaatattttgttgaggatttttacatctatgttcatcagggatatttatttgcctgtggttttctttctgtgttgtgtcctgggaactttttttttctagcagggtaatgctgacctcatagaacaagtttggaagtactccttcctcttcatttttcggggaatattttgaataaaattggtattacctcttttaaaaatgtctggtagaattcagcagtaaaaccataattcttctgtttttctttgatgggagatttttattactgccttaattgcattactcattattagtctgttcaggtttttttattattctagcttgtgaaattgctatgcttccagacatttattcatttctcctggatttttcaatttgtttgtatataggtgtttttagtaatctcttacgatcctttgtgtttctgtgttatcaattgtaatgtctcctttttcatctatgattttactgcagttttctttctctttttcctagtctcattatagcttgtcaatttttttttcaaaaagcccccagctctttgttcctttgtctttttgtaattttttttttagtttctatttctaaaatttcttctctaatcttcatgacttatttctttctactaattttagcatgtgatttttcttgcttttctcattacttaaagtgtactgtcagattggctatttgagatctttctacttttctgattaggcatttatagctatgcacttcgcctcttaactgcttttgccgcatcccacaggttttgttatgttgtgtttctattcttatttctttcaattaatttttaatttcccttattcgtttcaatgaatttttaattttttcatttattggtggtttgtgggcatgttttaactttcatatatttgtacagtttttaaagttcctgctgttactgattgctagtagtattccactgtgctcagagaagatacttgatatgatttcagtttttaaaaatgtgccattacttgtttttc

SEQ ID NO: 466682 - DNA, 2093 bp, Homo sapiens
tgtcacctctggctccactcgaaaatggcgccgaaatcgaagaacttcttaaatttcattgcaagctttttgcaaaggtttctgggatttgcctgcgaagctgtttcgccgcgtccgagagcgagcgaacgtgcaagccagcgagggagacagggaggaaggaagggctggggaggcggagagacagaccgagcgagcgacacacggacagcgacggacagcgacagaagcggggcccgggacttgggagacggcgaggttgcggggcgcgaggtgctgggcacggagctacagggacggagagccgagagccggggtcgcagcgtggagggggcgctggctgctgccgaagctcggagagcggcgtggcggaggcggagcggagccgagcgaggggccagcacggaacgctcccttggaggcgagcggcgcagccggcggagaggctcccggagccgccctagaaaaagccggctcggggggcgtggccacgcgctgtggcgctccccgccccccggtggccccgctcggctccggggcccgggggcggaaggggggaggggaggagaggagctacgaatagcgagggctcggggagaaaaaacggaggatggcaaacggcaaagccaagggcacgaggtagcgcagcgcgcacccagaggctcctgggacggacaccaccccacgctcacgggtcctctggcggtgtcctttgagctgccgggacggcgcaaggtggctgagcgaagctttttgctcggtgcttacagggagtacctgagatggtttgggaaaggaaacagggggtctcagaccgcttgggtgcagcgctctccccatgcgtttgagtgcagatctgtcgagacgccccagccctcgccaccccaccaagctctcaggtagagaggccccgggacaggaaacctgtttatgcaccctcctgcaatcccaccacctgcccaggccaagtgagcccctctccgctactggtgtttcataatgctgggagctactttgatttcatgcattgcccttcagctgccatgttatgaggacacttggagaaagctacaggagaggaactgaggtctcctgccatcagccacttgagtgagcatgggagtggattctccaaactccagttaagacttgagatgtccacagtggcagccactagcttgactgcaacttacgagagaccctgagccagaggcactcagttaagtcatacacagtttcctgacccgtaaaacctgtgacacaatgaaggtttgttgttttgggggtaatccgttattcagcaatagataacgaatacagaaggcttgtaattgtataaccaacgtgagtttataagcggatatctgacctcatttgttttctcctgaaaaagttatagaaaaatcacaagactgcaagtcactctctctctttcttttgtggggaataaacaagtataattacaatttctaaacctattgttttattctcaaatataattacaatttaaacaggatattgtagagctccatcatagggattaacactaattagaattaaagaacgtttttgtgaaagtcagcttttttttttttaaataaacactcgtcccttgataatgtatttctttttcataaaattaaaaaaaaaatgtgggttgtagtaggtgtatatatttatgtggtacatgagatgttttgatacaggcatgacgtgtaataatcacatcatggaagatggcgtatccatcccctcaagcatttatcctttgtgttacaaacaatccagttacactctttttgttatttaaaaatgtacaattaaattattattggctatagtcaccctgttgtgctatcaaatattaggtcttattcattcatttaactatttttttgtacctatttatcatccccatccccggttccctcccaccacccaccccactacccttcccggcctctggtaaccatccttctactctctagctccatgagctccattgttttgatttttagctcccacaaataaatgagaacatgtaatgtttgcctttctgtgcctgacttatttcacttaacataatgacctct

SEQ ID NO: 466683 - DNA, 2776 bp, Homo sapiens
  misc_feature (2)..(3): n is a, c, g, or t
  misc_feature (5)..(6): n is a, c, g, or t
  misc_feature (8)..(8): n is a, c, g, or t
gnncnncncagcccgtgggccacctgctctcttccacgccttcctttctcctctgcttgtgcagcggaaggttctgccagcaggggagttagtgagcagccagtggagggtgtgcccagccttcctgctgcagacccgcccccaagtcaacacggacttccctccctgcgcgccagaactttgcgttgttcttagtggcatctggggtcgaggagggcgactgtcagccagttgggggatgttttcttcttggtctctcggcttctgcttccctgtgagctgggcagcctcagcccaggtcctatccggtactcagctggcctcggtgtgcacagcgcaggcttgagtgcagccgtgggggcgggcggggcagaagcagggcccctgggaacagctgagtctgaagggtcagaagccacggcccctgtggggggctctggggcagccaggggagctgctcgttagtcgtctctggggcagaaggaagggaccttcacctgggttgggactgggcctgggtccccagtctcacagggagctcgtcctgattgtacctgcccggctgtgacggctgagcccgggctcctggaggcaaggccacctcaggcctccagggccggagccgcaaggagctgctgggtttccacagggccacgggggctgcggccacacggagcgggagcacaggtggggacactgaagctgagctcacagccaggagagggacagcagagtgacggccgagaccatctgcactgcgagggaagcagcgcccaccttccttggtggtccgggaaggccggaccggccccttgggtccccactggcctcagccactgtgggctcgtccagcttcagctgccaggagaggccaggccgaggtcaggaggctcagcagctggttccatgacttcctcttcgctgaggaggtcaggacagaagcttctagatgacaggccgcccaacttggtataaaacagcaaatttctgtgcctgtgctgtcgggctgtgaatgacttctcgtctgtttcatgagatgcagcttcagcccagggagccatcagatgcagccgggcgagacgcggagccaagagctgtcctcgccccccatgtgagtgactggagagacgaaattctcaaagtcttgtcacttacggggatatttttaacccaggaccagggaagcacagctctcattggtggccgagtgctctggcgcttgggcagtgggcagcagccaggttatcgggacgtgctcaggcccaacaggacccccagagccgcacctgccccccacagagtagagccggcccgggagcggccttggtcacatctaatcccaccagccgccgacagtggagagctgtgcctggcccagagatgtgggcatcacatccaggctgcaaacacacggggaccacctggccccgccagggttcgctctatcctggcttggcctgcatggcctctcgccgtctgcatgtgaacagacccttcgcccccagatcccaggccctgtgcagcctgccttgcccctcccactgcaacccgaccccaagcagccactgatccttctgtgtttcctgtcaccacgggttcatccatgttttctagagtttctgtaagtggaatcacgcagtatctagcctttctcgtctggcttcttccactaagcgtagttagtttgagatttatccatgttgctgtggtatcaacagtttatccctttacagtcatacagatagaccacagtgtcttcatccatccagatgttgacgggcattccggtggcttccagcttggggctgttgcaaataaagtgtacagtgaacattcacatgcaagctttgcacggacatttatttcttttctcttggctaaatcggagtggaactgcttgattgtgtggtcggtgcatgcttaactttacaagaagttgccaagctgttttccaaagtgcctgcaccattttccattcctatcagcagtataggagacttgtagtttctccacacggtcaccagtacttgacatgatcagtctttttaatttcagtccttctaagaggtgactgatggcgtctcattgtggttttaatttgcattttcctcatgacgaatgacactgagcatctgtacctgtgccaacttgctggtcttcgctgaagtgcctgttcacatcttctgctaattatttatggggttctatgtttccttaatgagttttgagagttctttgtatactccagatgcaaatccttcatcaaatatgtacattgctggtgttctctccttatatatgacatgttttttcattctcttaacaatgtcttttgaagagcagacatttttaattttgattaagtctaacttacccgtcttttattttatagagtgtgcttttgctgtcgtatctaagaaatctttacctaacccaaggtcacaaagactgcctccattttttttcttctagaagttttatagttctaaattttacatttgtgttcatgatccattttgagtttttttttatatggtgcaaggtctggattgactctttttcattttttattgcatatgaacgtccagttactccagtatcaagatcattcttttttactgaatagccttttgcatctttgtcagcctgctaggattttaattggaattatgctgactctatagatcattttggggataattgacatcttaatgatatggaaacttctaatctatgaacagtttctctcagcaatgtgttctcattttcaatgtgc

SEQ ID NO: 466684 - DNA, 2317 bp, Homo sapiens
gagggtaagtggcgtccacaggaagatggcggccgagcgcggcgagcaggcagggtctggttgagggctggggtggtgacggcgtgattgtgcctggctaccgggttctcagccaggcagcacctgattcccaggagagatggaatcccagctcagaaaggggagactcatgcgagggcagaggcaaggcacccgcccagaaggattgggggtctccccatttcacaggtggggacactgaagctgagctcacagccaggagagggacagcagagtgacggccgagaccatctgcactgcgagggaagcagcgcccaccttccttggtggtccgggaaggccggaccggccccttgggtccccactggcctcagccactgtgggctcgtccagcttcagctgccaggagaggccaggccgaggtcaggaggctcagcagctggttccatgacttcctcttcgctgaggaggtcaggacagaagcttctagatgacaggccgcccaacttggtataaaacagcaaatttctgtgcctgtgctgtcgggctgtgaatgacttctcgtctgtttcatgagatgcagcttcagcccagggagccatcagatgcagccgggcgagacgcggagccaagagctgtcctcgccccccatgtgagtgactggagagacgaaattctcaaagtcttgtcacttacggggatatttttaacccaggaccagggaagcacagctctcattggtggccgagtgctctggcgcttgggcagtgggcagcagccaggttatcgggacgtgctcaggcccaacaggacccccagagccgcacctgccccccacagagtagagccggcccgggagcggccttggtcacatctaatcccaccagccgccgacagtggagagctgtgcctggcccagagatgtgggcatcacatccaggctgcaaacacacggggaccacctggccccgccagggttcgctctatcctggcttggcctgcatggcctctcgccgtctgcatgtgaacagacccttcgcccccagatcccaggccctgtgcagcctgccttgcccctcccactgcaacccgaccccaagcagccactgatccttctgtgtttcctgtcaccacgggttcatccatgttttctagagtttctgtaagtggaatcacgcagtatctagcctttctcgtctggcttcttccactaagcgtagttagtttgagatttatccatgttgctgtggtatcaacagtttatccctttacagtcatacagatagaccacagtgtcttcatccatccagatgttgacgggcattccggtggcttccagcttggggctgttgcaaataaagtgtacagtgaacattcacatgcaagctttgcacggacatttatttcttttctcttggctaaatcggagtggaactgcttgattgtgtggtcggtgcatgcttaactttacaagaagttgccaagctgttttccaaagtgcctgcaccattttccattcctatcagcagtataggagacttgtagtttctccacacggtcaccagtacttgacatgatcagtctttttaatttcagtccttctaagaggtgactgatggcgtctcattgtggttttaatttgcattttcctcatgacgaatgacactgagcatctgtacctgtgccaacttgctggtcttcgctgaagtgcctgttcacatcttctgctaattatttatggggttctatgtttccttaatgagttttgagagttctttgtatactccagatgcaaatccttcatcaaatatgtacattgctggtgttctctccttatatatgacatgttttttcattctcttaacaatgtcttttgaagagcagacatttttaattttgattaagtctaacttacccgtcttttattttatagagtgtgcttttgctgtcgtatctaagaaatctttacctaacccaaggtcacaaagactgcctccattttttttcttctagaagttttatagttctaaattttacatttgtgttcatgatccattttgagtttttttttatatggtgcaaggtctggattgactctttttcattttttattgcatatgaacgtccagttactccagtatcaagatcattcttttttactgaatagccttttgcatctttgtcagcctgctaggattttaattggaattatgctgactctatagatcattttggggataattgacatcttaatgatatggaaacttctaatctatgaacagtttctctcagcaatgtgttctcattttcaatgtgc

SEQ ID NO: 466685 - DNA, 923 bp, Homo sapiens
gctccctcacctcattgagcaggactgttgcggtaaactgaggaacggagagaccagtatgagaaacaggaggattgtttattttaggtagagagctttcctctgaaacaccttgagctgtttttgcttttagacatggcttacaacggtttccatcttcctgttttgttgtggttcccaggcggtgccttcgagactggctcagcctccatcttcgatgggtcctccctggctgcctatgaggacatgctggttgtgatcgtccagtaccggctgggaatatttggcttcttcaccacatgggatcagcacgctcccgggaactgggccttcaaggaccaggtggctgctctatcctgggtccagaagaacatcgagttcttcggtggggaccccagctctgtgaccatctttgatgctgtctcccatggccgaaggcttattccacaaagccgtcatggagagtggggtggccatcatcctttacctgaaggcccatgattatgagaagagtgaggacgtacgaatactgttaacaccttgccagcttcctctcctcagttaggggagaatgtgttcaggcaccttctcaccatgtgccatctatcccacgatatttgtcatctgtctcttaattatctactacagagtgaggccctagagaccaggatctctctgtccttcaggcccccagcataataagtggtatatatcaggcagctataaatgttctggatgaatgagctaatgaatgagctgtttcattcaatgcatattaattaagcactgggctgtggagccatctcttgagtattaatgattttagtggtaaattttcttaaacattttatagaaagtaacagtatataaccaagagcagaaacatagagttatgaaattgtaaaaaaaaataccctcaatac

SEQ ID NO: 466686 - DNA, 3819 bp, Homo sapiens
cctccaggagagtatgacaccaggacatcaaggcgtccacccttgtcaggcctgggatggtgccgcactgttggggatgggtttcattctctgcctccagcacaccagcctttctccgtttctgccatgctcagagttccttttgagcttgggccttggctcatgtcgttccccagcaaaggctgctcttccctgcccctgccacatcctaccttcaaatgtcgctgactctgggagtcttccctggtgacccacccaccccagcacacttatcctgtcagtccccttgaatgccccccaaggtgaggctgccgagccaatggctcagcgagggctggggagccctgacctgaccctctcctccctccacccagcctctgcgatctgtatgcaccactttgctaagacctcccaaacctctacaccctcgcaggctgacagggctgcaggtgccagcactgacctccctctgccctctgctcctgtccctccccttccgcaggcaccgcccccaccacaactccgccacctccagccgggctctggggtcctcctgggccacctgcttactgtgtgtccctggacacggcgtctcccctcgctgagttactttcctcatttgtaaaacggggatatgacccgtctcttagagtgactgggaagatcggtggtatcaacgcaaactacagcccggcagcttccaggcaaactcacttctcaggacgcctgtcctgctgtcttctcaaagaggtggatgaagccaccaccacccggtttacagatgaggaaactgaggctcagggagatctggaaaccattcccggcagctgggctccgaacccaggcctgcgagcacaaggctggctcccgcccccggctgtggtccctcctcctccggggcagggtccggtcgtgccagacgctcgatgacagcccccgcgggggaggccaggctgggagaggagagggcagggggcgggggcgcctgaccgcgtggggtcggccgcgggtcgatacgacggcgggatgaatgggagaggggagcgcgggcgagagggtgagggaggaggggaggaggggagaacgggagaacgggaggaggagggagaggcccgagcagggggcccgcccccgccgcccccctggtccccgccccgccgagcgtgcccggccgggtctgcagccgtcagcgccaagcgcggccccgcggctccgccgagagatcgataactaatttcaccgcggtagccgccccagtttttccccgataattgcgcgccggcagctgtgagcgaggcccccagcgcggcgcgaagcccctcccgcgccgatcaattgacaccgccaccgggcggcaggaaaactcatttttctttctctccccggctccgggtgggcgcgagctgagctctgccaagggccgggggctgcttggggccggggcggggagggagggcaggtcccggggagggggcgcggacgcgggtttgggaaagaggcttgcgaggaatccgaggaggcggggtgcctcagtttctccactctaccacaggggcgtggccgaaggcctcagggacctggggtgcgggtggggcagtcctgtcccctcttagctgttgggatggcggactggctggtgggaggaagggctaagtcaggcgccgcggcctggacgcgtgggttctactctggactcacaccagggaccactttgtgacgttgcatccgttccttcccttcgtctcttcctctccgagcctcagtttccccatcttccgaaaggggcctggcatatcctgggcaggcagatggtggatcagaggtagtgaggtgcctacaaggaaatgctcccaacagggtggcttggaggaatcctccttcctcagcactcatgggccgggcactgttctaggccgtgggggtggggatcgagcagtggccacactgacaaagcccctacccttgtggaagtgacattctactgaggccatggacacgtacagtacccaatctcccaccctccacctgccagaatgacagaggctcccccatggagattcctggcatgcccagccccacgtctgggttgagagtagtgactcagaagaaaatgaaggctactgctagcaaccaaatgaggtcaccgtcaagattcccggataaaagtcattcatgagacacaccagtgtagccttgttggcttggagctcctcagaggacggcgggaacagagtgaccgagggggtggccttgggctgacctgtgtggacagaggagggggtgagagatggcagagggagtgtggggtgttgtggagcgcctctctctgtctaaagtctctgggagggttcatggtgtggccgtctggtccacccagggcctctccttccctcctcattccctcctttccactggagccctctgcagagcagacagccctgtgccttcctaggagcccttcccaagtcacctttcccaggtgtcctggcccagccctttcctctgcagcctcggtttccccgtgtgcacccagggcaggctgtgctccctccttcctggtttctggagtctgagtttggaatctaggggtctccctcacagcacacaaaactgtactggcaggatgtggggagacccaagcctggcatggcctggagcttcccatcccctggggcaccaggctgtgccccagcctggcccactcagctctcctggtgaagcgtgggctccacccagacacaccctggggctctgccgtcgcccctgtccccaccagcccgaccacaggacccttcacagcagctgggttcttggggctgctcccccagactttggggcaccgcagcccccatgcccaccccagcagcctctgatgcccctggacttcacctggcagccatggagttctctgcactcccaggtgcacgtgtccgctcgatcagcttagaggatgggacaggggagagctagaggggatagcttgggccttagaatctgtgcccatgagctgagtgactcggacgggtcacctcacctctccgggctctatccccgtctgcacaaaggggatcacagcaggacctgcctatggggccaccgagagggaggttctgcccctgaaatgattatcgcctgtggacccccacatcccctggaatctctcaccccttacctgccccaccggctcctcaggctggaccggctgcttcctccaggggctccagggcccagggccctgctctgcgatgcagctgttgggcgcagcaggccatgggttaccacggccagacccagcagcagcaggggccagcgctgcctgagtgtgggctccctagagagtggtgccctggtccctctcgctggcagcagctgtcccattgcaccccagtccatgtggccccatcctcatcctctggtccctgcccccagccaggccccttccagagtccatgaccaggcggggctggaaatgctgctggctctgctcacactccagggctgggttgagttggctggatttactcatgggaagccttatcagaccaaaattcgaagggagagagaagccttctccatcatccaggcagagggacccatccctgaggaccaggaccagggacggggcctgactgccttccctggggcacagagaagggagggagtggtgaaggcctcaggcctaggacaggcagctgaccaccaccctcccctccccaccatccaggccagggacaatctgagaaccaactagcaatccagcaatgggacacattcagcagaaccctggaaggtgccccaggaaccaggcccaaggcctct

SEQ ID NO: 466687 - DNA, 723 bp, Homo sapiens
tggcgtccggatggcggggttgggtgcaggaaaaaggttaaaacatgcaagttctcccctcccgcccactttgccttcttccacctgggattctaccagaaagaattctggtattgaaaggaaactcctggggctggaagcctgagctctctgggcttggtctctgctctgctggggctctgggaaagaaagatggtgacctctctgagctccagcttctcagcaaggaggatcttgtttactggagaagtctggtgactgctaatctcatgatatatgagagtgaacggtgtcatgtcataagaatgtacagctcgaaagaaacaggctttactcaaagtcacagaacctcaaccgtctcctgccttcacagccctcctgcatatctggttagtgtcccatccagtaaccgtaacagcccacatctcatcataagcagcataggctgtggttgagagaggaagagataatctgaaacaacagtatatgactcaaactctcctcttctcctcctcccataagcacaattccctgaaaggcttcttctaagcctggtatcctgggagtggcagtgttttcagcgtggcagacagagcagtcaggaagctgggagcccaaacagcgtgagacaaagccacaaaacagaggccgcgcatcagtcggtaagtcatttctgtcttacatctcaccttgataatgaaaggaaataaatgtcttggtcac

SEQ ID NO: 466688 - DNA, 1355 bp, Homo sapiens
ctcctcctcctccttctccttctccttcttcctctgaataacgagaagtttaacttgatgaggttcatagaagaaagttacggttatcaggaaaggatctggacttactctggctctagaggtcaacattctgatggcagcatcctgaaccccaaacttcccttaaggagaatcgttcctggacccataagtttggcattgggccccagatgcctagattatggctcacatgatgagatcctggaagcagtacttagaacactggctttctgtctccctaacagccccactgttgcagagtttctcttggcgagtcagttctgggatgctcttctagagacattccaaatcatttcttacctagaacttatttcttcagccagacaaaagaatgaaccagatgctgcagagttcagccgggatgagagttgttggggtcacaggggagatcgagttgtggttatcttatttcttgtgggcttttccaatttccggttccagaccctcaggggactcttctgggctctgctcccttggcttctgcatacattctgggctgaagataaccagaaagccagcaacctgatgggaggaacattcattgcacaagctgagagtgaaatgagcttctacatcagtgccttcagagacacatggccctgccgacaccttgagtttggatttttggcctccagaactgggtacaagctggaaaaggggaaaatgaatcatgctacaggccaagtgtccatcactgattcccagagatgccctttgtgtggtaggcacttccatgtggactcgctacagaggtcataagaccctaattccagagggccctaccctataaccagaaggaagaactattgcacagagaatctaagaagaatctagacagacagccctcgctggatttctccactctgttagcattcgatcatttgccttttgtccagtcatatttctgcatggctgtccatactttgttgaacctaagcacaaaatggaaagttttccctgtatctttgggtcgtcattctgaaggctcccatgttatgtaaaactatgatcaaataaatatgcatgccttttctcctataagtctgccttttgtcagtgattttcagtgaaccttcagagagtgaaggggaagttttcccttggcccctatatcagtttcctcaatacctgccatgcagaaaatctaaactaagatgtgccaaacaacaaggtatccagttggtagaagagctcttactgagtgacactagggagttgttgggtaaagatctatttcagactttcaattaattatctgaaagcaggattcaggagtgtgaagggagacttgtggc

SEQ ID NO: 466689 - DNA, 1702 bp, Homo sapiens
gaccccgtgggtgctgactggcagctgcaggcagggtagcaggtgggcagtggtgagaatgccttctccctacaggttccaggccccgattcccttatcctgggggacgacagcatccatagcctggactttgcctcaagccggcagggcggggactacgtggccctgcagcccctgtgctccgagggtgggcctcccatgccccaccgtagcatctttgcccccccatgcactgcccaaccacaatcgcagcctgtcctacaataatgtgctcaaccctggctcgcctggtggccacgcctgcctcgcccatccagcagttggcgtggccggataccactcaccctacctgcaccctggggcaacgggcgacccaccatggcccctgccccacagcttcagtcccgtgctgggcccccggccccaggagccctcgcctgtgctctacgacatcctgtccaggaccatcatggcatccatccaggagcgcaaggacagggaggagcgtgagtgcctgctgcgctcccaggccgactcactcttcggcgactcaggcgtctatgatgctcccagctcctacagcctgcagcaggccagtgtgctgtctgagggcttccgaggtcctacgctgtgctacagctctacagatgaccttgtggccaggcccggcttcggcggcgcctgcaaccctgtcctgcagacatcattgtcctcgctttccagctccgtgagccgtgcactgcggacgtcgtcctcctccctgcaggctgatcagaaccccttccgagaccctgctcagctggcccagcccctgcccctgtgttacctgagaatctccagctggatgtcctccatctggtccagcacgccccagatgtccttcttgaggttctgggggccagaggagcccttcagggtttctcgctctctgctcctcgctggacagaaaagatcctggcagcctcgccctccaccctggatcccctccccactaccccctgcccctgggactgggagccgcctctttaagctcctcctggaggtgggctgccgtcctctgcccctcgtccccacggaagaggccacgctgttacccatgggaccggttttgggcggccgaagagcactcatggggccggattcacgccccgggcccgttccctcctgctctctggtgctcctcacgccattggccccactgcctctcactgcccgccgccggccttctccccggaagcctgcagggtcccctctgatccctgcacctctggggggtcacaccaactgcgggtgtttcctcaccacgctgggcgcttggtgagcacgttctgccttgagacctggcatttctttgataacatttcttctcgtttcctgctcattctggaactcctgtcagtcagatgttgggccttttggatagattctgtgagtccttctttctacctttgcttgtagataagattttccttgaatccaaacacacacactctctctgctttttaaaaaattagttttggggctggatgtagtggcttacacctgtagtcccaggcactttgggaggccgaggcaggcagatcacttgaggtcaggagttccagaccagcctggccaacatggtgaaaccccgtctctactaaaaatacaaaaagtagctgaatgtggtggtgtgcacctgtaatcccagctactcaggagg

SEQ ID NO: 466690 - DNA, 1113 bp, Homo sapiens
cgactactactactaaattcgcggccgcgtcgacgaggttttaaaacattcttttctagctatctattgaacatttactttatgccagatccagtacatgccattgttatcctctgtttacaggtggggaagctgaggcaggaagccctttagtcacttgccgaaggccacgctgttacccatgggaccggttttgggcggccgaagagcactcatggggccggattcacgccccgggcccgttccctcctgctctctggtgctcctcacgccattggccccactgcctctcactgcccgtgagtccctgtgcccgtgtcctccttcttgaacccctcagccctcagttaaccctcagaaagctggctcggagaagtccttgtgtggtatctgggaggcagagtttgccgtgagccgagattgtgccactgcacgcactccagcctgggcgacagagcgagaccccatctcaaaaaaaaaaaaaaaaaggcctcacgggactagaagcgtcttaccctgacctcacacctgctggacatcaggctggggagagaatcggggaagagggcattttccaacaggactggaaggccagtcgtggtccttggtggtgagagctagccaggccgccggccttctccccggaagcctgcagggtcccctctgatccctgcacctctggggggtcacaccaactgcgggtgtttcctcaccacgctgggcgcttggtgagcacgttctgccttgagacctggcatttctttgataacatttcttctcgtttcctgctcattctggaactcctgtcagtcagatgttgggccttttggatagattctgtgagtccttctttctacctttgcttgtagataagattttccttgaatccaaacacacacactctctctgctttttaaaaaattagttttggggctggatgtagtggcttacacctgtagtcccaggcactttgggaggccgaggcaggcagatcacttgaggtcaggagttccagaccagcctggccaacatggtgaaaccccgtctctactaaaaatacaaaaagtagctgaatgtggtggtgtgcacctgtaatcccagctactcaggagg

SEQ ID NO: 466691 - DNA, 1032 bp, Homo sapiens
cgactactactactaaattcgcggccgcgtcgacgagtacaggtggggaagctgaggcaggaagccctttagtcacttgccgaaggccacgctgttacccatgggaccggttttgggcggccgaagagcactcatggggccggattcacgccccgggcccgttccctcctgctctctggtgctcctcacgccattggccccactgcctctcactgcccgtgagtccctgtgcccgtgtcctccttcttgaacccctcagccctcagttaaccctcagaaagctggctcggagaagtccttgtgtggtatctgggaggcagagtttgccgtgagccgagattgtgccactgcacgcactccagcctgggcgacagagcgagaccccatctcaaaaaaaaaaaaaaaaaggcctcacgggactagaagcgtcttaccctgacctcacacctgctggacatcaggctggggagagaatcggggaagagggcattttccaacaggactggaaggccagtcgtggtccttggtggtgagagctagccaggccgccggccttctccccggaagcctgcagggtcccctctgatccctgcacctctggggggtcacaccaactgcgggtgtttcctcaccacgctgggcgcttggtgagcacgttctgccttgagacctggcatttctttgataacatttcttctcgtttcctgctcattctggaactcctgtcagtcagatgttgggccttttggatagattctgtgagtccttctttctacctttgcttgtagataagattttccttgaatccaaacacacacactctctctgctttttaaaaaattagttttggggctggatgtagtggcttacacctgtagtcccaggcactttgggaggccgaggcaggcagatcacttgaggtcaggagttccagaccagcctggccaacatggtgaaaccccgtctctactaaaaatacaaaaagtagctgaatgtggtggtgtgcacctgtaatcccagctactcaggagg

SEQ ID NO: 466692 - DNA, 355 bp, Homo sapiens
agcctttcccacttctatctcctgtccctgcagccaggagccgcctctttaagctcctcctggaggtgggctgccgtcctctgcccctcgtccccacggaagaggtcattctgtagcccagcttttattttcgcctaatgtatctctgaggttttaaaacattcttttctagctatctattgaacatttactttatgccagatccagtacatgccattgttatcctctgtttacaggtggggaagctgaggcaggaagccctttagtcacttgccgaaggccacgctgttacccatgggaccggttttgggcggccgaagagcactcatggggccggattcacgccccgggcccg

SEQ ID NO: 466693 - DNA, 1770 bp, Homo sapiens
gaccccgtgggtgctgactggcagctgcaggcagggtagcaggtgggcagtggtgagaatgccttctccctacaggttccaggccccgattcccttatcctgggggacgacagcatccatagcctggactttgcctcaagccggcagggcggggactacgtggccctgcagcccctgtgctccgagggtgggcctcccatgccccaccgtagcatctttgcccccccatgcactgcccaaccacaatcgcagcctgtcctacaataatgtgctcaaccctggctcgcctggtggccacgcctgcctcgcccatccagcagttggcgtggccggataccactcaccctacctgcaccctggggcaacgggcgacccaccatggcccctgccccacagcttcagtcccgtgctgggcccccggccccaggagccctcgcctgtgctctacgacatcctgtccaggaccatcatggcatccatccaggagcgcaaggacagggaggagcgtgagtgcctgctgcgctcccaggccgactcactcttcggcgactcaggcgtctatgatgctcccagctcctacagcctgcagcaggccagtgtgctgtctgagggcttccgaggtcctacgctgtgctacagctctacagatgaccttgtggccaggcccggcttcggcggcgcctgcaaccctgtcctgcagacatcattgtcctcgctttccagctccgtgagccgtgcactgcggacgtcgtcctcctccctgcaggctgatcagtacaggtggggaagctgaggcaggaagccctttagtcacttgccgaaggccacgctgttacccatgggaccggttttgggcggccgaagagcactcatggggccggattcacgccccgggcccgttccctcctgctctctggtgctcctcacgccattggccccactgcctctcactgcccgtgagtccctgtgcccgtgtcctccttcttgaacccctcagccctcagttaaccctcagaaagctggctcggagaagtccttgtgtggtatctgggaggcagagtttgccgtgagccgagattgtgccactgcacgcactccagcctgggcgacagagcgagaccccatctcaaaaaaaaaaaaaaaaaggcctcacgggactagaagcgtcttaccctgacctcacacctgctggacatcaggctggggagagaatcggggaagagggcattttccaacaggactggaaggccagtcgtggtccttggtggtgagagctagccaggccgccggccttctccccggaagcctgcagggtcccctctgatccctgcacctctggggggtcacaccaactgcgggtgtttcctcaccacgctgggcgcttggtgagcacgttctgccttgagacctggcatttctttgataacatttcttctcgtttcctgctcattctggaactcctgtcagtcagatgttgggccttttggatagattctgtgagtccttctttctacctttgcttgtagataagattttccttgaatccaaacacacacactctctctgctttttaaaaaattagttttggggctggatgtagtggcttacacctgtagtcccaggcactttgggaggccgaggcaggcagatcacttgaggtcaggagttccagaccagcctggccaacatggtgaaaccccgtctctactaaaaatacaaaaagtagctgaatgtggtggtgtgcacctgtaatcccagctactcaggagg

SEQ ID NO: 466694 - DNA, 1809 bp, Homo sapiens
aggcgcaggcgcaggcgcagaggccgacaccaccgggcggctggtatgtgtccaccggcccctaggcgcctcgagccccgcccctgggagacgcaggctcctccccgcggagcgagagcccgcggagctgctccgaaacccgcgggagggcacctccggtcacccgagccgcaaatccccgccgtccgaagaaggtgtcgccccgggctggcggcccagcgtggcttaggccaggtacaaccggcagcgcccgccaagccctgggctagggacgcctgcgggagttcacggggaggcgccggtgtctgaggtctgagaagacagcggccaccggaaaaggtgctaatgtttgcagaccccgatccatcgacaccccaaggaaatgctgtgcacaaaattccaagagggccttttcgaatagacgcatgaacggtgtttgtgtctggatcgtccagcctcccgggatcgattgggaatctagcttctgcttgcctttccagcgcgacgcacagtaggagcctaataaatgtttgttgaatgaatgctgaatatcgaactcagctctggaggccagaagcctaagatccaggtgtctgcaggaccctgttccctcctctgcaggctctgggggaggctccttcttgcctcttccagttcccgggggatctgggtgtcccctggcttgtggcggcaccactgtattctctgtgaatccacgtggccttctcctctgtgtttgtgacttctttccttcttataaggacacctgtcattggatttagggccctaatccaagaggatctcatctcgagatccttaacttaattacatctgcacagatgctttttccaaataaggccttttacttcctcttcgtggttcttcttcatgaagagcagctcctccttgagggcctcgatctctgtctccagctgcagccgagtgacattggtgtcatcaatgaccttgcaaagcccatggatgttgttctccacagactggcacatggccagctctgtctcatacttgactctaaagtcatcagcagcaagacaggcactgtcgatctgcagaacggtgcgggcattgtccacagtatttgcagagatctgagccctcaggtcctcgatggtcttgaagtaatggctccagtctctgacctgggatcccttcttctccagatgctcccggattttgctctccagcttctggttctcagtctccaggctcctcactctgcccaggaagagatgcggcccctggatgtcgccgagctgtcagaaccggaggaagtggaggtgctggagctggaggggggttttgagcagtttctgctcccggtcatccatgagatgccagaggacatcgcgtcgctgacaagcactggcgggcgtacctgtggaagcggagcacgctgtgggagatggacaatatgctcttccagatcaaaacccaggtggaggcttcggaggagcatcctcaaccgcctccacaacccgggcgacgcagtggagggcagggtgaccaagaggtgccagaaggccgaggagaaggccaaggaaatggtgaagatggcagagatgctggtggagctggcccagaggatagagacgaacgagtcgagagcacggtcggtggtttacagccaatggattctgaagatgactccatacagcaactactgaagaaaggaccagacttcagctgggaatgtggatgggccgacctggctgggacccatgaatctggagaagagctggagaatggagagtattatctgtatttgaggactttaatttctgtgtaaga

SEQ ID NO: 466695 - DNA, 967 bp, Homo sapiens
aaaatactaatggattttaaatggagctgcttcttcagctggcaaaagccaagttgccttcaggttgtaacagaagatagagaggaaggccttacagttatggacttacttctgacagcaacttattccatcattcccaatttacagatgagtaaactgaagcacaggaaatttaaatcactttctagaagatttggctgccatcatctctgtaataccttgtcgctcccgctgaactgtgagttccttgaggacagagaagggactctgtatctctttcccatctctacatcctcaggtcacagagcctggcacaacgtggaatttcttctcaccaggacagtgcatgctgcggcactccatgatggtacctcatccctgcctctgatgcccagtgccaatcacccttctgccggcacagttacaacctcgactgcgtagttgacacaatgcaaccctccaagttccagaatgatgcttcttttctaggagctcccagagagccaaagccttgagtgtcccacacagaacagattccctctccccagcctggcatccctcttggtcatcccagcaccaagaggactgtctgagcaccaatgtctcaagaagacttttgatgacaacagtggaaaccatttcttcagcttctctttacattgtttctttctctagaatctgcatgcaggattttccctctggattaaatgaccaatctctgagacagacacccattttcttctcccaaccttcctccccatcattcatgcactgattgtgtttcttccaccaaaggctttaagtaagttgacttgtgaaaacttcatcccagagtgtctaccttactagtcctttataactgcctattgcaggcatttttttcaggtcaaatgtgggatgtctgctacataccaaaaaggaaactgggactcagaaaggttaggaaatgtgcctgaaaacatataat

SEQ ID NO: 466696 - DNA, 1102 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466697 - DNA, 1250 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtggtaagcggccgggcggaccggacgtcgccttggttacagcctctggcgggaggggtgagggtcgccatggttacggcgtggctcccgggcagcaaaaaacccatcctaaacggctgggcccatgcaagcgcgcccaccctgacataacccagactgagcctgcaaacacaaaacaacaaaccacaccaacacacccacacaaagagagaggcacaaacacccaagacacccaccccacaagagccacaagaaaagaggagcaggggcgcgcgcggcgcccgcccccccggcgcaggacacggcgccgcccgcgcgtgcggacactaccgccgcgcgaagcggcgagcgcgaccgcccgcacctaatctcgcgcgcctaccgcgcagcagcagcgcggcgcgggacgggcaggcgcgcgccctcgccccccaccgcacccccaccccgccccggcgccgcaccctcccacacggcgcgagagccgcgcgatcgtcgcgagagcgagcagtgcggcacggcaggcgcaggggggcgagagggagagcgcgcgccggacgagcgcgggcgggcgcgcactacggggccaccacgcctcacccacccagcatacggcccgcgaccctcccactcggcgaacaccacccacacaacaaaacaatattcacaccagcccccaacacccccccacacgacacacccaccaaatacccacacactactcacacccatacatcaccacactacaaaccatcacacgcatctcaaccatcgacaatcattaccccactcacacctccacacccaaacacacagcccgagcaacctaacgacaacacccaccaacccaaaactaataatcttacaacgtaacccacaaccaccacaccctccctacacaatcttaacaccgctactggtcctttgtattaccatatcttcaccacctcaacatcttccactatacgcaccaccacacccatcccctcacactccaccact

SEQ ID NO: 466698 - DNA, 416 bp, Homo sapiens
tgtggagcacctacccttaataatgagaaaaaaaagagcaaatgacggtacaactatatataagaaagactgggaagataaaaaataaaaagagggaaaatagaatggacctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466699 - DNA, 110 bp, Homo sapiens
tcaagcttctaacgatgtacggggccatgacccctacttggggcagaaaaaacccatcctaaaggctgggcccatgcaagggcccacctgaataaacagaatgagctgca

SEQ ID NO: 466700 - DNA, 1119 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtggtaagcggccgggcggaccggacgtcgccttggttacagcctctggcgggaggggtgagggtcgccatggttacggcgtggctcccgggcagctcttgactggcccctggttccacagcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466701 - DNA, 1321 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtggtaagcggccgggcggaccggacgtcgccttggttacagcctctggcgggaggggtgagggtcgccatggttacggcgtggctcccgggcagctcttgactggcccctggttccacagcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctgggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctctgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaaca

SEQ ID NO: 466702 - DNA, 1210 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtggtaagcggccgggcggaccggacgtcgccttggttacagcctctggcgggaggggtgagggtcgccatggttacggcgtggctcccgggcagctcttgactggcccctggttccacagcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccgtatccttcccgcaggctctggaacctcgggctagggcgcctcggcgtccagcctgtgttggtcctggggccaacacagccatgccagagagggacacagtcgctgtctccagcttagtatgtgttgagggcccactctgtgctcagctgcaggggtcagggctagatcttcagtgctgtatgcaaaatacaaagccatgcacaaaagagccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466703 - DNA, 1765 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtggtaagcggccgggcggaccggacgtcgccttggttacagcctctggcgggaggggtgagggtcgccatggttacggcgtggctcccgggcagctcttgactggcccctggttccacagcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccgtatccttcccgcaggctctggaacctcgggctagggcgcctcggcgtccagcctgtgttggtcctggggccaacacagccatgccagagagggacacagtcgctgtctccagcttagtatgtgttgagggcccactctgtgctcagctgcaggggtcagggctagatcttcagtgctgtatgcaaaatacaaagccatgcacaaaagagccaggtgggttgtcagggccactagctgagccctgaatgcgagtagccgggagaaactggggcagggacaggcagtggttgggccctgggatgaggctgtaggtgtgcagggcagatttcgtgggacctgaagcccgtggagtgtgtcgcctttattggactggctcatcttgatgagggaatagcacataggggagatgaggggaagaattccagggtcttgggaagtcagaggggccctgggcttgggctgaggcctgcaccggagcaccttgactctggcccagctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctgggactctgggctgtggagggtgaccccacagtccgtggctgtctcacagggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466704 - DNA, 888 bp, Homo sapiens
ccgacgccgtaggttccgctactgccgcatgctggaagagggctccttccgcggccgcacggccgacttcgtcttcatgtttctcttcgggggcgtccttatgaccgtatccttcccgcaggctctggaacctcgggctagggcgcctcggcgtccagcctgtgttggtcctggggccaacacagccatgccagagagggacacagtcgctgtctccagcttactgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctgggactctgggctgtggagggtgaccccacagtccgtggctgtctcacagggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466705 - DNA, 467 bp, Homo sapiens
cttggttacagcctctggcgggaggggtgagggtcgccatggttacggcgtggctcccgggcagctcttgactggcccctggttccacagcagctggagctcctcagcccctttcaactctacttcaacccgcaccttgtgttccggaagttccaggtgaggccgccccgcgccgcgcacctgtgggcccgacccacccaccccgcacctgaccgcccgtcccccgtaggtctggaggctcgtcaccaacttcctcttcttcgggcccctgggattcagcttcttcttcaacatgctcttcgtgtatcctgcgccctgcggacacgggctgggtggagggcaggccggccgggctgggagagaggccgggacggggaaactgaggccccgcctggtggcacttcctataccgacgccgtaggttccgctactgccgcatgctggaagagggctccttccgcggccgc

SEQ ID NO: 466706 - DNA, 1229 bp, Homo sapiens
cctcatggacagaacaaacacctcagcaatgaaacctgttcatgtctaagagcagctgggctgggaatcttcccctttgttcaaggccttccagtaaggcccagctgtccccttgctgtgcatggggctctggggagttccactctttgatggagggcagaggccctgagtgcaaactccctgggaagagtcccatgctaacatgtgctcaaaggagccctcctctcacatctcagcgaccaagaaccccaatccctaatcagagctctgcctctgccccacatggggccctaccccacttccagggagcacagcagcctctgaccctagccctgccctggcagcatgggacctgccaacagctgagggtggcagcagtctgtgctgggatctgtgcccggatctgtgcccattctcttcagtaaggctggagctgcgagccagtttgctgccctcccagatcctgtgtccattctgaagaatggggacacctccctattacagatgagaacagaggggacatgaactccttggaggcagggctgggaagggaccctgggctgtgtctcctccctgtaccgtgtcaactccaagagctggcaccaggccgggagggctattcccatattcctcacagctggcttgtaaggcaggagctggcccaggccacagcacctgctggggtgggaaagggccccagctgacctggctatgggtgccactggagctagaacagccctcctgcacccaggctggcgacagcccagcagtgcccacacaggactgggccctccgcaggggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctctgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaaca

SEQ ID NO: 466707 - DNA, 1001 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466708 - DNA, 1616 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtggtaagcggccgggcggaccggacgtcgccttggttacagcctctggcgggaggggtgagggtcgccatggttacggcgtggctcccgggcagctcttgactggcccctggttccacagcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccgtatccttcccgcaggctctggaacctcgggctagggcgcctcggcgtccagcctgtgttggtcctggggccaacacagccatgccagagagggacacagtcgctgtctccagcttagtatgtgttgagggcccactctgtgctcagctgcaggggtcagggctagatcttcagtgctgtatgcaaaatacaaagccatgcacaaaagagccaggtgggttgtcagggccactagctgagccctgaatgcgagtagccgggagaaactggggcagggacaggcagtggttgggccctgggatgaggctgtaggtgtgcagggcagatttcgtgggacctgaagcccgtggagtgtgtcgcctttattggactggctcatcttgatgagggaatagcacataggggagatgaggggaagaattccagggtcttgggaagtcagaggggccctgggcttgggctgaggcctgcaccggagcaccttgactctggcccagctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466709 - DNA, 987 bp, Homo sapiens
  misc_feature (1)..(1): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
naattnnncncnnnncnttccattggctgtcgggctcaggggctctcttttcagcctggggcgcgcagcgcctcggatgcggattggccgaaggcggggctgggaggcgggttaaagagcgcgttgctggctgggccacgcgtgcttgagaaggttcaatggcgtggcagggactagcggccgagttcctgcaggtgccggcggtgacgcgggcttacaccgcagcctgtgtcctcaccaccgccgcggtggtaagcggccgggcggaccggacgtcgccttggttacagcctctggcgggaggggtgagggtcgccatggttacggcgtggctcccgggcagctcttgactggcccctggttccacagcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctgctgctggggattgcggtgggccatatctactacttcctggaggacgtcttccccaaccagcctggaggcaagaggctcctgcagacccctggcttcctaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 466710 - DNA, 1158 bp, Homo sapiens
actgtaatggtacgaccgcgctcagctgaattactgtccccttgctgtgcatggggctctggggagttccactctttgatggagggcagaggccctgagtgcaaactccctgggaagagtcccatgctaacatgtgctcaaaggagccctcctctcacatctcagcgaccaagaaccccaatccctaatcagagctctgcctctgccccacatggggccctaccccacttccagggagcacagcagcctctgaccctagccctgccctggcagcatgggacctgccaacagctgagggtggcagcagtctgtgctgggatctgtgcccggatctgtgcccattctcttcagtaaggctggagctgcgagccagtttgctgccctcccagatcctgtgtccattctgaagaatggggacacctccctattacagatgagaacagaggggacatgaactccttggaggcagggctgggaagggaccctgggctgtgtctcctccctgtaccgtgtcaactccaagagctggcaccaggccgggagggctattcccatattcctcacagctggcttgtaaggcaggagctggcccaggccacagcacctgctggggtgggaaagggccccagctgacctggctatgggtgccactggagctagaacagccctcctgcacccaggctggcgacagcccagcagtgcccacacaggactgggccctccgcaggggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctctgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaaca

SEQ ID NO: 466711 - DNA, 696 bp, Homo sapiens
ataacagaaagaagtcccgttgaagatgggagagaaaggaagctacctccatagagtcatgtgcctagcatcaaatgtgaagggtaaaggtgggaacccagttacctctgagtccctcttgtgccaggatgtcaccagtgcatacaacctccctgccacagagagaaagtgtgtgcagaatgtatttgcatttcgtttgatgcaggtgagtgcctttcaggaatacagtcccaaagaggcggtgggttttaaagaggggacaaaaccctccaactctaacttgactcaccgtatgatgctggaccaggaactcagccgagcgtcccagttttcctggtctggaaaatggggaacgaagaaaacagcatgcatgggaaaggagctctattcccacccaataatagagctcctggaagttggtgctgggagcgttgcagggaagaaagggttaatattatctgagtgtgtgtgactggcaaaaaaggcccagagtggagactaggggaggaatcccaacaattaatgaacatgtactttgtgtcaagttctgtgctaggtagctattagaattcctgtttgacacatgatggacatggaggaaaatggatccacagagaagtaataaaactgagcctagctctacccagtggagttaggatgctaacttcagtttcattccagtgtcttgagttttaa

SEQ ID NO: 466712 - DNA, 2543 bp, Homo sapiens
atcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggaagccaggcctctgctgctgctgctgctgctgctgctgctgctgctgctgtctgcagcacacctccatgggcagggggccttggcctgcactgggggagagggggaacaacaacagaggaagctcatgtggcagggagtccagtaactgcccagctttggagggatgacggtgagaacaacggcaacagctacaggaaactgagccctcagaggccctgtgaggtagctgtggtttgcatcactctttacagaagaggaaacagtctcagggaggcccggctgcaagactgggtgacacacacagggagtgtggatctgggccagtggtatgagcacggtgccaggtggctcccgccactccctggggatccaagtgcggggtggctggggtgtaactgggggagaggaggagagcctcactgtccctgtcgctgacacctggcaggcggggagctttaaggtggccacccaggagaggaacccccagagagcccagatgaggctgcggaggcagaagaagggtgtggtccccttcctgggggattttctgactgagttacagaggctggattcggccatcccggacgacctggatggcaacaccaacaagaggagcaaggtgagcagctggggcactcacgttggatgagggtggggatgtggacgtcacagtccaccctgggcaggacactccctggctccatcctctacatcttaggcttactgggagtgtttgacacacacaggaggaggggacctatcccaggagaaaatgggaaaagcactggaatcaaagaccaattcctgcaggaggggctgtttatatccaactctgagaacaggctgggggcgctgcatgggaccccttcagaaaactgccccagggaccagccccttctccctgcctgccaaaggcccccacagcaacttccacccaggccctgtcagcatcctgtcctctgtctctaggaggtccgagttctgcaggaaatgcagctgctccaagtggctgccatgaattacaggcttcggcctcttgagaaatttgtcacctatttcacaagaatggagcagctcagtgacaaagagaggctgcactgcagtgtcaccatctctgttcactgcaacgtctgccttctgggctcaagtccttcctcagcctcccaagcagctgggactaccgctgtacaccaccatgtccggttgttctgctgttgttgttctgctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactaaaaatgttctgtagttgttggaatgagaaaagtaactccagtgcggtaaccatataccagtctttaggattcatagcctagcatgtcaaattgaggctatggctgaacaagttatggaatagcattcacattacacatgccaagcatttaatgttttccttctttattcaaattattgttaactctgcttaagaaaacaaacagaacaaaacaaaaccccttaaaagccatagtatgtcacccaatctatgtcacccatagtatgtcacatttgttct

SEQ ID NO: 466713 - DNA, 1940 bp, Homo sapiens
atcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggaagccaggcctctgctgctgctgctgctgctgctgctgctgctgctgctgtctgcagcacacctccatgggcagggggccttggcctgcactgggggagagggggaacaacaacagaggaagctcatgtggcagggagtccagtaactgcccagctttggagggatgacggtgagaacaacggcaacagctacaggaaactgagccctcagaggccctgtgaggtagctgtggtttgcatcactctttacagaagaggaaacagtctcagggaggcccggctgcaagactgggtgacacacacagggagtgtggatctgggccagtggcggggagctttaaggtggccacccaggagaggaacccccagagagcccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactaaaaatgttctgtagttgttggaatgagaaaagtaactccagtgcggtaaccatataccagtctttaggattcatagcctagcatgtcaaattgaggctatggctgaacaagttatggaatagcattcacattacacatgccaagcatttaatgttttccttctttattcaaattattgttaactctgcttaagaaaacaaacagaacaaaacaaaaccccttaaaagccatagtatgtcacccaatctatgtcacccatagtatgtcacatttgttct

SEQ ID NO: 466714 - DNA, 2193 bp, Homo sapiens
atcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggaagccaggcctctgctgctgctgctgctgctgctgctgctgctgctgctgtctgcagcacacctccatgggcagggggccttggcctgcactgggggagagggggaacaacaacagaggaagctcatgtggcagggagtccagtaactgcccagctttggagggatgacggtgagaacaacggcaacagctacaggaaactgagccctcagaggccctgtgaggtagctgtggtttgcatcactctttacagaagaggaaacagtctcagggaggcccggctgcaagactgggtgacacacacagggagtgtggatctgggccagtggtatgagcacggtgccaggtggctcccgccactccctggggatccaagtgcggggtggctggggtgtaactgggggagaggaggagagcctcactgtccctgtcgctgacacctggcaggcggggagctttaaggtggccacccaggagaggaacccccagagagcccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagaggctgcactgcagtgtcaccatctctgttcactgcaacgtctgccttctgggctcaagtccttcctcagcctcccaagcagctgggactaccgctgtacaccaccatgtccggttgttctgctgttgttgttctgctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactaaaaatgttctgtagttgttggaatgagaaaagtaactccagtgcggtaaccatataccagtctttaggattcatagcctagcatgtcaaattgaggctatggctgaacaagttatggaatagcattcacattacacatgccaagcatttaatgttttccttctttattcaaattattgttaactctgcttaagaaaacaaacagaacaaaacaaaaccccttaaaagccatagtatgtcacccaatctatgtcacccatagtatgtcacatttgttct

SEQ ID NO: 466715 - DNA, 2059 bp, Homo sapiens
atcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggaagccaggcctctgctgctgctgctgctgctgctgctgctgctgctgctgtctgcagcacacctccatgggcagggggccttggcctgcactgggggagagggggaacaacaacagaggaagctcatgtggcagggagtccagtaactgcccagctttggagggatgacggtgagaacaacggcaacagctacaggaaactgagccctcagaggccctgtgaggtagctgtggtttgcatcactctttacagaagaggaaacagtctcagggaggcccggctgcaagactgggtgacacacacagggagtgtggatctgggccagtggtatgagcacggtgccaggtggctcccgccactccctggggatccaagtgcggggtggctggggtgtaactgggggagaggaggagagcctcactgtccctgtcgctgacacctggcaggcggggagctttaaggtggccacccaggagaggaacccccagagagcccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactaaaaatgttctgtagttgttggaatgagaaaagtaactccagtgcggtaaccatataccagtctttaggattcatagcctagcatgtcaaattgaggctatggctgaacaagttatggaatagcattcacattacacatgccaagcatttaatgttttccttctttattcaaattattgttaactctgcttaagaaaacaaacagaacaaaacaaaaccccttaaaagccatagtatgtcacccaatctatgtcacccatagtatgtcacatttgttct

SEQ ID NO: 466716 - DNA, 1010 bp, Homo sapiens
gccagggccagcagccttcagtcggtagctggccgtagaaggaggaggagctccgactacattctgtccttgtgcctcttggacttttttgtgtgtttaggtgcccaatggggagcaaactgacttgctgcctgggccccagcgggggcctcaactgtgactgctgcaggccagatgtgggaccctgccatgagtgtgagattcctgagactgtggcagccacagcaccagcatccaccactgcaaagcctgccaaattggatttgaaagctaagaaggcccaactcatgcagtacctcagcctcccgaagacgccgaagatgctgaagatgtccaaaggtttggacgcccgctccaagcgctggttaaaaataatatggagacggcacgggatttggcctctagaaaatataggtcccactgaagatgtgcaggcgtctgcacacggcggtgtggaggagaatatgacatcagatattgaaatacctgaggccaagcacgaccaccgtcccactgaagatgtgcaggtgtctgcacacggcggtgtggaggagaatataacgtcagatattgaaatatctgaggccaagcacgaccaccgtacgtatttttttttaaacagctttatttacgtgtagttgacatgcaaaacattcacccatttaacgtaagtgattcagcgtttttactatattcacagggttgtgcaaccattgttacaatctaatcttagaacctctttattccccctcaaagaaaccccactagtagtcactcctctgtctttcccaactcccacacccctggatctaggcagccacgaatgtacttcctgtttctatagtacagtgcttttctgtattaactggttcttaaggtgactatttcacattgatgaagttgctctagctagaaagccaaggctctttcatttctttctgcccttctcctttgccttccttcagcaccaaggagaatggtccagcagcagctcagtccatgcctgtcaa

SEQ ID NO: 466717 - DNA, 1775 bp, Homo sapiens
agtggcaactctcttgtatatgtgggttaaagaccctcagcctcaagccaagcctcctccatgaggagccatctcactattgaccggctagtgccggctccccatgaggacaccgtacacgacatcactaacgaggacgccacacacgacatcgctaacgaggatactgtacacgacatcgctaacgaggccgccgacaagggcatcgccaacgaggacgccgcccacggcatcgccaacgaggacgccgcccacggcatcgccagcgaggacgccgcccacggaatcgccagcgaggacgccgcccacggcatcgccagcgaggacgccgcccagggcatcgccaacgaggacgccgcccagggcatcgccaaggaggacgccgtccacggcatcgccaacgaggacgccgcccagggcatcgccaacgaggacgccgcccagggcatcgccaaggaggacgccgcccagggcatcgccaacgaggacgccgcccagggcatcgccaaagaggacgccgcccagggcatcgccaaggaggacgccgcccagggcatcgccaacgagggcgccgcccagggcatcgccaaagaggacgccgcccatggcatcgccaacgaggacgccgcccagggcatcgccaacgaggacgccgcccacggaatcgccagcgaggacgccgcccacggcatcgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgcacgctaacgaggatgctgtacacgacatcactaatgaggacagtgtacaagccatcactaatgaggacactgtatatggcatcgctaacgaggacactgacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgagccattgacactggagaatgatacgtaccctgaaataactcacttcctgaggaaaaagcgccatctctaggatttgattgtggagagcatatctgatgatggggatttgtaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggc

SEQ ID NO: 466718 - DNA, 2039 bp, Homo sapiens
agtggcaactctcttgtatatgtgggttaaagaccctcagcctcaagccaagcctcctccatgaggagccatctcactattgaccggctagtgccggctccccatgaggacaccgtacacgacatcactaacgaggacgccacacacgacatcgctaacgaggatactgtacacgacatcgctaacgaggccgccgacaagggcatcgccaacgaggacgccgcccacggcatcgccaacgaggacgccgcccacggcatcgccagcgaggacgccgcccacggaatcgccagcgaggacgccgcccacggcatcgccagcgaggacgccgcccagggcatcgccaacgaggacgccgcccagggcatcgccaaggaggacgccgtccacggcatcgccaacgaggacgccgcccagggcatcgccaacgaggacgccgcccagggcatcgccaaggaggacgccgcccagggcatcgccaacgaggacgccgcccagggcatcgccaaagaggacgccgcccagggcatcgccaaggaggacgccgcccagggcatcgccaacgagggcgccgcccagggcatcgccaaagaggacgccgcccatggcatcgccaacgaggacgccgcccagggcatcgccaacgaggacgccgcccacggaatcgccagcgaggacgccgcccacggcatcgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgcacgctaacgaggatgctgtacacgacatcactaatgaggacagtgtacaagccatcactaatgaggacactgtatatggcatcgctaacgaggacactgacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgagccattgacactggagaatgatacgtaccctgaaataactcacttcctgaggaaaaagcgccatctctaggatttgattgtggagagcatatctgatgatggggatttgtaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccatttaactgctcattgactcttactgtagatgaggaggtggccagcagcccctgccctcccccagttggtaggcccaagtttacttcatcaagccagcaaagtggatatgtgtcccagtctcctacgacgcagtcctaaataatgtggtgaagggaagtcgtaatcaatgtcatcaatggactcagataaatcacatcatttttgctgtgttctctgggttagaagaaagtcacaggtcccattcacatggaagaggaagggatttcacaaaagcatggaca

SEQ ID NO: 466719 - DNA, 1379 bp, Homo sapiens
cagaaagttgacgctgaagaaggccggcgccagtaaaatgagaaattggtcatgcctagctgggggtggcattgtgtggtgacagggctcaaggagggtgttaggtccccactgtaccccagccagtgagcctggggtgtccttctcgcactctttgcctccatttccacatctgcaaactggagaggcagctgagcattcaatcaggaagccaaggggagcgccctcccaaggatgcctggtggcaggtccccttccctcaccattctgccatcaccctgggccttgtgggagaggagcctgcagattctgttgacccagtttccttctctgtaaaatggggaaattggtcatttaatttaattcgatttatggaatggaaaatattttcacagacatcaaaattcaaaacctgggcaacaagagtgaaactctgtctcaaaagaaaaaaaaagaaaagaaaagaagaagaagaaggttcatcttcagactcctagtccagagctctcagcaatcctcatcttgtaatgctgtctacagactccaagatctcccaacgtgaattagcaaccgatgcatcaaaggtggcacctcggccgggcacggtggctcacgcctgtaatctcagcactttgggaggccgaggtgttggagcgggccggagagaagtagagtgggctgcgaggagaaggaaacaggcctttcggaggctcctcatccctcggaggtcatcccttactccaggtgatctgaacctgaagtccgaggccccaagagttctaagtaacccaggggtggaggtggggtgggggatcccagctctttccgatctgggagatcagaaagatgctcatctgggagagtgggacctcccctttcagtccgcccacccccgaggaccgcacttggagggccgcacttggaggaccgcgcctccaaggcgggcgcggctgacgcccggggcccaggccatgtggggcgtgcgtgccgggagaagtgtcccagcgcctcaccccgcaagcatgagaaccacgaaacccccggggccgggaaaccggggcggggcggggcggggcggggccgggaagcggcgcggggctgggccggtgacgtcgcggccccgcccccggccggctccctcctcccggagcgctccccagcggagtcctcacctgcaggcacaggtgtgcgcacttcgcatctcgaaggccggccagcaagcttcagagaacgggaagtgctggggagagaaggacggggatgagctcttgggaaaacccccagaatgaagacatctctgagtctgggccaggtggacacgaaccactaggcagtggacaacagcatgtccttccaatggcaaggcagggaggctccct

SEQ ID NO: 466720 - DNA, 406 bp, Homo sapiens
cagaaagttgacgctgaagaaggccggcgccagtaaaatgagaaattggtcatgcctagctgggggtggcattgtgtggtgacagggctcaaggagggtgttaggtccccactgtaccccagccagtgagcctggggtgtccttctcgcactctttgcctccatttccacatctgcaaactggagaggcagctgagcattcaatcaggaagccaaggggagcgccctcccaaggatgcctggtggcaggtccccttccctcaccattctgccatcaccctgggccttgtgggagaggagcctgcagattctgttgacccagtttccttctctgtaaaatggggaaattggtcatttaatttaattcgatttatggaatggaaaataaaaaaaaaccggcgcggccg

SEQ ID NO: 466721 - DNA, 2342 bp, Homo sapiens
  misc_feature (1)..(1): n is a, c, g, or t
  misc_feature (7)..(8): n is a, c, g, or t
ntgaagnngcagaagagtgtgtgacccatgtacgtgctccatgcatggccacttgggctattattgccaatcctggcaacggggctgtgagggcttctgaagtgggtggtgatatcactgccagatgcagccatcgacggtatagctgccccccaccacagcagtctctacagtaccaggaggtaggcggttttaaccacttgacacagaagctggtgggcacacagggagggggagatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcagagccattaagtgggtgtggagtccgatcaatgtttctggggcctgctgctgctctgcacacgcccctcccagtctctctgagggccattcacgtctacaccggtcctttcctgttgtgctctgggccactgggctctgttgaccaccatcatccaagctgcagccaccagggggtctgcatggcactttcctgacccttccttggagcctctccccttctgccctttatctcttatctttgcacctcagggctcctggtctctgaggctgtggcaccctggcttgctccactgtcagatggggtcccatgacttcactctttggtattctaggcaaacatcttccttaaagttctagacatctcatacaatggctttggggatcctggagcctctgcggtgggtgaggctctgaaggccaacaacgtgttggaggaactcaacatgagagacagtctcctgctggccttgaactcttgggctgaagcagtcttcctgcctcagcctcccaaagtgctggaattacagtcatggggagttcatcgttgttacatagagacctgtgattcctatagcacaggcggatggctgcgaattgcacacggtgtataaagcatctccggcagagcctggtgcatgtaacaaccgcatctctgcgatgggagccctgagcctgggcctgggcctccgggtcaaccagacgctgaggattcttgtacctcaccagagcattctgtctgactatctgatggagacaccttctgagccgaaacagtgtggccatagtggctgtgtcctcagagatgaggagcccctccttccctttcacattgctctctggccttcccggacctggcttctcgcagctttgtgtgcgtgtttctcaggtgtccaggaatcccatgcgaagtgaaggctgctttggtctcctcaagtctgtccaggacaatccagcctctgccctggaactgctggatttctcagatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgctttgacctccagggtatatacttgaaagaaatgaagacatatgtccccacaagaactcgtgcatgaatatccatagcaacattatttataatattctaagagtgaaaatgcccaccagtggataaatgcaatgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaaccgtatggtatgtgaacggcatctcaataaaactgtttcgaaaagaaggaaaaggacggacacatgctgaaaacgggtgaaactagaaaacatggcgctaagtgaaagaagccagccacaagatcacgtgtcgcatgaccgcatttatgtgaaacatccggagtatgcaaatctatacagacagaaagtagattatacattgcctaggtgcagagaaatggaagtattggaggttgacggctaaaggatgtggatttctttggggggtgataaaagtgttctaaaattgattgtggtgatgtgcgactctatgaatacgctaaaaaccgctcgattgtacattttaaatgggtgatttatgcggtatgtgaaatacatctcaagaaagctgctgcaaaaaatatcatacgggttgagcctagtggtattaaaaaagtataaatatgg

SEQ ID NO: 466722 - DNA, 1136 bp, Homo sapiens
ccacggtgactccagcatcatggccaggcctgagtcctcctgtctctgcagagggacaacatggaggctgtgccagggatttctgtccctgcatcagacagccactgtcgtgaccttggagtgaacaatgaccatggaggccgtgccagggatgtccctgcatcagacagccaatgtcttgaccttgaagtgaacagtaagccagctgatgaaggggagagggtgaaggaagaagttgtcatcagttctgcctatctgttggagcccccagattttggtggtggctttcattgggtcagcccagctcctggaaatcgtccttctcattctgttgacagagtggttcggctgagatttgtggatgccagtatctttccctacattgaattgagtgaacatagactatggagtcaaccagatctagaggacttcggctatgtttcccccaccccagtctccctggatttttctggatgtcctttgggatgtgctgagaataaatatgccgatattcttccattctgttcattgcaagagcgtacaacactcccttcagcagtcctggatttatccagcaatgctgggcttacctactgcagacacctgtccactgagaggacccacttgtcatccctggtcaattacatgatcatgtctctggacttgccctgtgatgctggacaggagctgacagccgggatctgggagcaataccttcaggatagcacagcaaggaaattgaaggcgtgtgggagagcatatggaacattccttcaaatgcatttggtcatagaagcctttactggaaaatacctcccatggctagtaaaaagcaaaaatgactgagaagcactggtttatctctgccaagaacaaaatctaggaggaggtacctgtttcctccacactgggtaaatctagtggcccaatctgctgtgcaccttcccacccaggtgcgttctggggagggttgagctggttgagtgtatcaagagttgattcctttggatggctgagtgctattccataagatggatgtagcacagtttaactgttcacctgctgatggatggctgagttatttctagatttttggctattgctattaaagctgtaatgaacattcacgtacggtt

SEQ ID NO: 466723 - DNA, 710 bp, Homo sapiens
tttgatgctgaacacttaggggatgactttccctgatccatcccccaacccccatccttcctgccccaccgtgcacagggatgaggctgctcacccaggtctctgtgactctgttcatgtcattacttgtgatggaacaacagctctcttcccaccgtgctcatgggcaaactccttttccttctgcagaaaaaccactccttcttctatgccctggggtcactggggagagctctccactaacttgagctctgcttggacaaaccaaaagaaagccggggccagaaagaaactcagacatcatctggcttacattttaatcttgcaactgagaaaaggtagactctcagcagctcctggcaataaacaactcaggcgcaacgggatgtttcttacaaggagcagccgtgcagtgattgctccactctgagggtctgactcagcccttcctcagcttctgggcttattttagccccacgtttctggaggaggaaacgagaacatgatcaaggatgccgtgggaagagcctggggccctccagttctctcggggagcctcgggaagctcctcgcagtttcagctactgtagaaattcacagccaagggctcctacagaattgggctgtcagcctggccagcctgggcgggtgggccccgctgtaagaaagcctgccatttggaaatgagaattagagcaaaaggatacatt

SEQ ID NO: 466724 - DNA, 1053 bp, Homo sapiens
ggcaggagtaagtccttacttatcaataataacattgagtgtcagtagactaaacttttcaatcaaaagatagagtggatgaatggatgaaagaacaagacccatccaggcatgagcctgggtcctcagccttgaagatcttatagaaaaaagcaactactgtgttatagaataacaaactttaaatagaaacaaagacattttaatacaatcttaattactctgtgaacatgtagattaacctttaaatataggcttttttttttcctcaaaacaggataagagttatcttctcatttttaatttccaagttgaaactacagatgactatgtttactgaatcacatttcaggatcttaaatcttcggacaattatcaaccaagccgctggaacccctccgccgggttccgaggccctcgctgttctcaggccagcgcagaattggtcccagggctggactcctccaggtggggcgcccggagcactcccgaccacctgctccaaggacactgcctcctggaagcgtccctggtttcccttcggaggtgaactcgttcagggcacttctcggagaaggagaggctccagaggccctggactcgggggacaaccctcgcttcatcacctcctgagggtccaccgcagccagccctgggccttctgcccctttcactccaagatctctgggctgaccttcatcagccccttccacccgcctcaggaggtagggacaaggctgggggtggcctttgcagaccctgagaatgaatattgtcctgcatacacagcccagtggccacgagaggccgacgaagatactgaagacctccgggcaggaaaagaaggtagaggggatattcactgagcccccgcctcgagcctgggcccgacctggggtgtttgccttactggccgctccagccagtgtgagaggctgcactatcatgcaccccactgacaggaaaggaactggttgtgtggttccctgtaagctctggagatggggcgggcagtagggggaggagcacagcagtgtggatgtattaatactt

SEQ ID NO: 466725 - DNA, 1077 bp, Homo sapiens
tgaaccaccacgcccagctaattttttgtatttttagtagagatggggtttcactgtgtcggccaggctggtcttgaactcctgacctcaagtgatctgcccgccttggcctcccaaagtgctgggattacaggcatgagcctgggtcctcagccttgaagatcttatagaaaaaagcaactactgtgttatagaataacaaactttaaatagaaacaaagacattttaatacaatcttaattactctgtgaacatgtagattaacctttaaatataggcttttttttttcctcaaaacaggataagagttatcttctcatttttaatttccaagttgaaactacagatgactatgtttactgaatcacatttcaggatcttaaatcttcggacaattatcaaccaagccgctggaacccctccgccgggttccgaggccctcgctgttctcaggccagcgcagaattggtcccagggctggactcctccaggtggggcgcccggagcactcccgaccacctgctccaaggacactgcctcctggaagcgtccctggtttcccttcggaggtgaactcgttcagggcacttctcggagaaggagaggctccagaggccctggactcgggggacaaccctcgcttcatcacctcctgagggtccaccgcagccagccctgggccttctgcccctttcactccaagatctctgggctgaccttcatcagccccttccacccgcctcaggaggtagggacaaggctgggggtggcctttgcagaccctgagaatgaatattgtcctgcatacacagcccagtggccacgagaggccgacgaagatactgaagacctccgggcaggaaaagaaggtagaggggatattcactgagcccccgcctcgagcctgggcccgacctggggtgtttgccttactggccgctccagccagtgtgagaggctgcactatcatgcaccccactgacaggaaaggaactggttgtgtggttccctgtaagctctggagatggggcgggcagtagggggaggagcacagcagtgtggatgtattaatactt

SEQ ID NO: 466726 - DNA, 1523 bp, Homo sapiens
ccctcaggactgagatgttcatccttttggcagcactcattgagaacctactgtgtgccaggcactgccctagtgctaagaattcaccagcaaacatgacagacacacctgctgtgatctccaagcttgcttccgcagaggggagttggagagtaagcaacttcttgcaagattctatttattccttagctgtcattgtgctgtgtgcacaaaggttagtgtttctgaagcatcctctgcctgccctcagcaccccactcctggcgctgctgccctcatacctgtggactgacaaggaggagaagcggggcccctgcaacgctcagtggtcccaggatgccagctatgttggtgacaaggatcctccagtccaggaagcacctggggttccccctagccctggccttcagtgtcagcccctggagggcaagcatggctgtctcctctctgcagttgaaaaaaccttttggtccagaagatccaaggccttctgggggctccagcctcccagaagccccccacaggcatcaccccttgcacctgggaatgaagccattctcaggtcgcaggctcactcgttgttcagcctgactggacataagaagctctacgtggagttattttaatctttcctcacaaatcaataactgcttaccttgaagcagttttaattagttaaggcctgctgagtgctctgctgataaactagcctgctattaatgctaagtatctgctgtgtagttgctatttttattattgttgttcttatgaaatcctcatttcctgagccacacagctgggactattatttaaaaatcaccttaggcttgagcctccttccctgaaacctggggaaagggccctttcctcacagctcagctcaccccttcccacgcctaccacgtgcaatacccttaacacaccattatattaatagaaagatgcttccttcaacaacagaaaacaacctccacaacttttgatatctgacttctgtagcaacagagccccctaagctctatgagccccaagatgctgttctgagtaactgtcttgtttcattttatttatttacagcaacactctgtggcattcccattttacatttgggaatctttgtatcatccccatttcacagatggtaaaacctaaggctgaaagatgtgaggaaaccgaaactctgagaggtcgcctaagtgggggggatgaaaaccagcgctctgaccacatcctggccttcgtcaccatgggattccgagggacaagcccaggggagttgcagcatcctctgtctaccctatgtacgtgacccccctttgcggtttttaaaccccactgcttgctgacagatttgtcacctgttataagggcagaatccattattattatcaatagtagtgatggatacttaaataataaatgcactaatctcattaagccacttatttaattaatctattttaattcatgtaattagttaatatgataatgcttcctttcatccaaagacagcctgcaggctc

SEQ ID NO: 466727 - DNA, 2788 bp, Homo sapiens
aagtagcccactccacctgggcaggaacaaacccacagccacccgaggaagagagaatgctggcaggataagggagatggggctgggagacatggtggagtggccaggccgggagtggctgcagggtttgagcctgggcccagcaggtctggcaggtcaccccaggggtctcctgcttgctcctgagccagtgtctgtgagagctgggtggcaaggccagcgggaggctgagggacccagggcccgggcatgtgggaagcgagggcggcctctccttggttcctcggcagcctggaccctcaccccctgcaaggtcctggtggccaccgcttgcagggccgtccctctggcagtgggcaggggggctgggggacactgggaagaccttcacccctccgaaggcaaggcctggtcacgttcatcctccatccctttcccgcctggactcctcctgtgtgctgggagcacttggccgtgtgagaacagggcagcatggtggacgggccagcatggcacggcgagttgagataagaggaaggcatctgtctcctgctcatccctgggcaatggaatgtcttggtgtaaagcctgattgtatatgccatctactgagataggagaaaactgccttagggctggaggtgggacatgctggcggcaatactgctctttaaggcattgagatgtttatgtatatgcacatcaaaagcacagcacttttttctttaccttgtttatgatgcagagacatttgttcacatgttttcctgctggccctctccccactattaccctattgtcctgccacatccccctctccgagatgtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtggggcacgatgcactgcggaaagccacagggacctctgcccgagaaagcctgggtattgtccaaggcttccccccactgagacagcctgagatacggcctcgtgggaagggaaagacctgaccgtcccccagcccgacacccgtaaagggtctgtgctgaggaggattagtaaaaggggaaggcctcttgcagttgagataagaggaaggcctccgtctcctgcatgtccttgggaatggaatgtcttggtgtaaaacccgatagtacattccttctattctgagagaagaaaaccaccctgtggctggagggtgaaggtactctacagtgtggtcattgaggacaagttgacgagagagtcccaagtacgtccacggtcagccttgcgacatttaaagttctacaatgaactcactggagatgcaaagaaaagtgtggagatggagacaccccaatcgactcgccagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttata

SEQ ID NO: 466728 - DNA, 1739 bp, Homo sapiens
aagtagcccactccacctgggcaggaacaaacccacagccacccgaggaagagagaatgctggcaggataagggagatggggctgggagacatggtggagtggccaggccgggagtggctgcagggtttgagcctgggcccagcaggtctggcaggtcaccccaggggtctcctgcttgctcctgagccagtgtctgtgagagctgggtggcaaggccagcgggaggctgagggacccagggcccgggcatgtgggaagcgagggcggcctctccttggttcctcggcagcctggaccctcaccccctgcaaggtcctggtggccaccgcttgcagggccgtccctctggcagtgggcaggggggctgggggacactgggaagaccttcacccctccgaaggcaaggcctggtcacgttcatcctccatccctttcccgcctggactcctcctgtgtgctgggagcacttggccgtgtgagaacagggcagcatggtggacgggccagcatggcacggcgagttgagataagaggaaggcatctgtctcctgctcatccctgggcaatggaatgtcttggtgtaaagcctgattgtatatgccatctactgagataggagaaaactgccttagggctggaggtgggacatgctggcggcaatactgctctttaaggcattgagatgtttatgtatatgcacatcaaaagcacagcacttttttctttaccttgtttatgatgcagagacatttgttcacatgttttcctgctggccctctccccactattaccctattgtcctgccacatccccctctccgagatgtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtggggcacgatgcactgcggaaagccacagggacctctgcccgagaaagcctgggtattgtccaaggcttccccccactgagacagcctgagatacggcctcgtgggaagggaaagacctgaccgtcccccagcccgacacccgtaaagggtctgtgctgaggaggattagtaaaaggggaaggcctcttgcagttgagataagaggaaggcctccgtctcctgcatgtccttgggaatggaatgtcttggtgtaaaacccgatagtacattccttctattctgagagaagaaaaccaccctgtggctggagggtgaaggtactctacagtgtggtcattgaggacaagttgacgagagagtcccaagtacgtccacggtcagccttgcggtaagcttgtgtgcttagaggaacccagggtaacgatggggcaaactgaaagtaaatatgcctcttatctcagctttattaaaattcttttaagaagagggggagttagagcttctacagaaaatctaattacgctatttcaaacaatagaacaattctgcccatggtttccagaacagggaactttagatctaaaagattgggaaaaaattggcaaagaattaaaacaagcaaatagggaaggtaaaatcatcccacttacagtatggaatgattgggccattattaaagcaactttagaaccatttcaaacaggagaagatattgtttcagtttctgatgcccctaaaagctgtgtaa

SEQ ID NO: 466729 - DNA, 3953 bp, Homo sapiens
  misc_feature (593)..(593): n is a, c, g, or t
  misc_feature (821)..(821): n is a, c, g, or t
tacacatacaataggaattctctataattcccaaggacaggccataattgaaagaactaatagaacactcaaagctcaattggttaaacaaaaaaaaggaaaagacaggagtataacactccccagatgcaacttaatctagcactctatactttaaatgttttaaacatttatagaaatcagaccactacctctgcagaacaacatcttactggtaaaaggaacagcccacatgaaggaaaactgatttggtggaaagataataaaaataaaacatgggaaatggggaaggtgataacgtgggggagaggttttgcttgtgtttcaccaggagaaaatcagcttcctgtttggatacccactagacatttaaagttctacaatgaactcactggagatgcaaagaaaagtgtggagatggagacaccccaatcgactcgccaggtaaacaaaatggtgatatcagaagaacagaaaaagttgccttccatcaaggaagcagagttgccaatataggcacaattaaagaagctgacacagttagctaaaaaaaaaagcctagagaatacaaaggtgacaccaactccagagantatgctgcttgcagctctgatgattgtatcaacggtggtaagtcttcccaagtctgcaggagcagctgcagctaattatacttactgggcctatgtgcctttcccacccttaattcgggcagttacatagatggataatcctattgaagtagatgttaataatagtgcatgggtgcctggccccacagatgactgttgccctgcccaacctgaagaaggaatgatgangaatatttccattgggtatccttatcctcctgtttgcctagggaaggcaccaggatgcttaatgcctacaacccaaaattggttggtagaagtacctacagtcagtgctaccagtagatttacttatcacatggtaagtggaatgtcacagataaataatttacaggacccttcttatcaaagatcattacaatgtaggcctaaggggaaggcttgccccaaggaaattcccaaagaatcaaaaagcccagaagtcttagtctgcggagaatgtgtggctgatactgcagtgtagtacaaaacaatgaattttgaactatgatagactgggtcccttgaggccaattatatcataactgtacaggccagactcattcatgttcacaggccccatccatctggcccattaatccagcctatgacggtgatgtaactgaaaggctggaccaggtttatagaaggttagaatcactctgtccaaggaaatggggtgaaaagggaatttcatcaccttgaccaaagttagtcctgttactggtcctgaacatccagaattaggaagcttactgtggcctcacaccacattagaatttgttctggaaatcaagctataggaacaagagatcgtaagtcatattatactatcaacctaaattccagtctgacaattcctttgcaaaattgtgtaaaactcccttatattgctagttgtaggaaaaacatagttattaaacctgattcccaaaccataatctgtgaaaattgtggaatgtttacttgcattgatttgacttttaattggcagcaccgtattctactaggaagagcaagagagggtgtgtggatccttgtgtccatggaccgaccatgggaggcttcgctatccatccatattttaacggaagtattaaaaggaattctaactagatccaaaagattcatttttactttgatggcagtgattatgggcctcattgcagtcacagctactgctgcggctgctggaattgctttacactcctctgttcaaactgcagaatacgtaaatgattggcaaaagaattcctcaaaattgtggaattctcagatccaaatagatcaaaaattggcaaaccaaattaatgatcttagacaaactgtcatttggatgggagaggctcatgagcttggaatatctttttcagttacgatgtgactggaatacatcagatttttgtgttacaccacaagcctataatgagtctgagcatcactgggacatggttagatgccatctgcaaggaggagaagataatcttactttagacatttcaaaattaaaagaattttttttttctttgagacagagtctcgctctgtcgcccaggctggagtgcagtggcgtgatctcagctcactgcaagttccgcctcctgggtttacaccattctcctgcctcagcctcccaagtagttgggactacaggagcccaccaccatgcctggctaattttttttgggtttttaatagagatggagtttcaccgtgttagccaggatggtctcgatctcctgaccttgtgatctgcccaccttggcctcccaaagtgctgggattacagtcgtgagccaccgtgcccagccaagaaaaaatttttgaggcatcaaaagcccatttaaatttggtgccaggaacggagacaatcgtgaaagctgctgatagcctcacaaatcttaagccagtcacttgggttaaaagcatcagaagtttcactattgtaaatttcatattaatccttgtatgcctgttctgtctgttgttagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttata

SEQ ID NO: 466730 - DNA, 1348 bp, Homo sapiens
ggacactgctgtctggaaccctacacagtgcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcagattccatggagagcctctcttacacgccctcctccctgcagccatcctctgccagctcccttcttaccgcccatgctgccagctcctctttgccaagagatgacccaaacactaatgccgtagccactgaggaaaccagaagtgagtcagagcttctcttccttccagattatctggttttgtccaactgcgagactggaagactgcaccataccagtctacccaccagatgtgatagctggtcaaactcagaccgttcattggaacaggcttcatttgatgatgtttttgttgactgcctgcagccgctcccctccagtcatttggtccacccctcatgccatggcagtggagctcaggaggtgccatcctcgaggcctcaggctgccctgatctggagtagagaaatcaatgggccacccagggaccacttgtcttcttcaccattgctggaaagttccttaagttccaccattcaggtagataaaaatcaaggttccttaccctgtggagcaaaagaactagacattatgtccaacactccacctccccgcccccctaagccaagccatctgtctgaacggcgccaagaggagtggagtacacacagtggtagcaagaagccagaatgcactctggttccaagaagaatctccctctctggtttagacaacatgagaacctggaaagctgatgtagaaggccaatccttaagacaccgagacaagcggcttagtttgaatttgccatgcaggttctccccgatgtaccccacagcttcagccagtatcgaagacagctatgtgcccatgagcccccaggctggtgcctctggtcttggaccccactgcagccctgatgactacattccaatgaactcaggaagcatctcaagcccgttgcctgagctgcctgcaaacctggaacctcccccagtgaatagagatctcaagcctcagaggaaatgtaagcacttgaccaggcctgctgtacaggggtaggggagcaaggttcc

SEQ ID NO: 466731 - DNA, 578 bp, Homo sapiens
atacagcaagaaggtctccttattttctaagcccaggacaaactgcatttctgtctgtcaggaccatttgttgcacagtccaagatcatccctgcatggaccctttccagaaatgactgaggactcagagttgtagcctctcaggatgttaaatatgaagaaacctgtctctgccctttgtaaacattagaagggaaaattatggggaagaattatttgccctttataagggaagcggggtagagcatcaaagggaactaacatttaaaaagcatttgctgtaatgtgggataaagcaaatgagtaattgtatgatattctaattctgtcattcccagtgttgctgaaaacccatactctcagcatggaagaagataaattcagatgttaaactagaagagatgaagttaaaatcctatagtcctgattttgaattgcttatgaattgatgatgaaatgtatgttttagaacatacagtttcctgaagaacaggagggatagctggagaggggataggagggaagctggaaggggttacaaagaggcccaaataaacttttgggggtgacagatatgt

SEQ ID NO: 466732 - DNA, 1951 bp, Homo sapiens
gtacccagtgttcagctcccacttataaatggatttttaaaaagataacaacaataataatactgtgaatttttttttccaagcatttctgttcaggtagagaattagagaagtttctctcttcttcttctccaagagccatctggctggatagcttttggtggatatttcatgagaggtaccagccaaacaaggagctccagaataatctgtttgaccggatagcccagcactatgccttacttttgtttcgtgtacccaagtcccactctgaagaggcgctcttaaaaaggctgccatcacttctcagcaaagccgtgtacaccagcttctgttgctgctttccacagtcctggttcgacacgcacgaattcaagtctgacatctgtaacacaatgagcctgtggatttcaggcacctatcctagcccacagagctatgacagctgggactactcggaactagacccagagcgattccgcagagaagaattaatgttgtacagaagaagactgacaaaggggagagagttttctttgtttgctggtaagagagccttctcccagaagccagcccagagcaggaaattctaccaccctcagcaccacccagggaaggtcttcactgagaaatcacaagcagtcagcaggaaggcccgtgccttcccaccaccaagacagcctgcccccctctgcaccctcgccatctgccatctctgtgcctatggagaggtcctgctcccctcccagctccctgtcctgtcagtctactctttcccaagcccccttccttactgtatctacatattctccctgggtggcctcatttggtctggtagcttcaaataccgcccatacgccagtgacccaccttcgccctggcctctcccggaactcgtacttgtctatccaccagccttctcagccacaccaggaggatttgaggaacctcaatccagctaccctggaagagtctccgtgttagcttcagaggccatgctgccaagaatgatggccaaaccatactgcctctgccaaggtgtgctactgtgtgccagtgtgactgaggactggatgttaaaagttctactctactccttgaaaaaccagttgctcctgtcaacagtctctccaaaaactggagtccgcatacttcccatttcctccccattgctcatttccatcttgaaatctcaggcaggggtggtgcatctgcagtcgtgtgctgcctgcaaaagccctgagctgacttcaaacctcttcaacatttatgggaagagccctctgattgtgtactttctccagaactatgccagtctgcagcagcacggcaagaatgtgttgatattccacagtacggggatttccttgacagcggaagccactgactgcaccccaacgtatactgatgtcatcagcgagaccctgtgcagcatgaagaagcggaaagacaacctcaatcagttgtaccagcatcattggactgaatggaattattttgacaagcatctaaaggagctgcaagacaacttctccaggaaccacactttcctatttctggatcttttgtctgttgctgcttctggacctgaaaatgccttctcctccctcctctttgttaactgccaacatcactaattcctgctcttcctccaggaccccgcttagacgtccctcatcttgggagccttccctaatataccaggagcaagtgttgctgaaaacccatactctcagcatggaagaagataaattcagatgttaaactagaagagatgaagttaaaatcctatagtcctgattttgaattgcttatgaattgatgatgaaatgtatgttttagaacatacagtttcctgaagaacaggagggatagctggagaggggataggagggaagctggaaggggttacaaagaggcccaaataaacttttgggggtgacagatatgt

SEQ ID NO: 466733 - DNA, 1077 bp, Homo sapiens
ctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggaaagatcagagagttatagccctgcctcctccactgaattgtgctccagctgcatctctgtatgccagccagaccagcaaacgctggagctcaggctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacgtcaaccaccccggcattccttgacttgtagacttgttttaaaatgtacccgggattttggctttattcaggggagtgtcttggtttattggtttatattcataaagaggtactgaaggaagcagggactttccctccctgtgtgtgccaggttgctccccttcattagttcaaagtcccccattagatgacccccacaatctgtctagtcatttccactgtgcagtagtgccaatatttatgtttcatatttgatttatttgttattggcattcagaagtcccctttcgtacccgattgcaccatgggcatggatcacagtgagcacatatctcaagtctgtataaacagtcaaggccttgtcctttcttcatgccagggctctggttaaggctattatctgagtctttggggctgaagtttgggcagggaagcttttggcctctatggttttccatagggagagaaccacatatcctgcccttctttcgctcttccgtgaagctatggccatctacaaaccctatgtcttcctttcctttttcaaccacatctctgctacagagaaccttgaaggtcatttctactaaatgcaagcggttaatattaggaact

SEQ ID NO: 466734 - DNA, 5668 bp, Homo sapiens
acctgctgaaactcagcctgctgggacgagtcttctttcccccttcttgtttctgccatggaagtgtgtggacagccccattcatgatgacatgtgacactactggcttttcccggcagtcacaccccctgacccagggcctgccagcttggttcctaacccccatgaatccacaaccataaccatggccacgcgggtcgaggtgggctccataacgcccttgacggccgtgccaggcctgggtgagatgggcaaggaggagaccctgacgaggacctacttcctccaggccggcgaagcctctggggctcccccagcccggatcttggaagcgaagagccccctgcggagcccggcccggttactccctctgccaaggctcgcccccaaacccttctcgaaggagcaggacgtgaaatctcctgtcccgtctctgcggcccagttcgactggaccttccccctctggggggctctctgaggagccagcagcaaaggatctggacaacaggatgcccggcttggtggggcaggaggtgggcagtggggagggcccgaggacgagctcgcccctcttcaacaaggctgtgttcctgcggcccagctccagcaccatgattctcttcgaaaccaccaaaagcggccccgctctggggaaggcggttagtgagggggcggaggaggccaagctaggtgtgtccggctcccggcctgaggtggctgccaagcccgccctgcccacccagaagcctgcggggacccttccccggtcagctcccctgtctcaggacacaaaaccacctgtaccccaagaggaggcaggccaagaccatcctccctcaaaggccagcagtgtggaggacacggcacgcccccttgtggagcccaggcctcgcctgaagagaaggcccgtgtctgccattttcacggagtccattcagcctcagaagccaggccccggcgcagcggccacagtgggcaaagtgccacccacccctcccgagaagacgtgggtgaggaagcccaggcccttgtccatggacctcacggcccggtttgagaacaaagaggccttgctgaggaaggtggccgatgaaggaagtggacccacagcaggggatatggctgggctagagaggcccagagcagcgtccaagctggacagggactgtttggtcaaggcggaggctcctcttcatgatcctgatttggacttcctggaggtggccaagaaaatccgtgaacggaaggagaagatgctttcgaagccggagatgggcagccccagagccctggtggggggctcatctggggtcacccccagcaatgaccagagtccctgggaagaaaaggccaagctggacccagagccagagaaggctgctgagtccccctcacccaggctgggaaggggcctagaacttgctgaggttaagagcagagtggcggatggggaggccgcggcagggggagagtgggcctccaggaggagtgtcaggaagtgcatcagcctgtttcgggaggacagcaccttggccttggcagtggggtctgaatctcccctggccacccctgcgtccccatcggcggcaccagagccggagaaaggggttgtgagcgttcaggaacggatcagaggctggactgccgagagctcagaggctaagcccgaggtcaggaggaggacgttccaggctcggccgctgtcggcggatttgaccaaattctttgaactaaacacgtgctacatcttcagcaacgaagtcaaatatgagaagagtgctgagctgagcggcgagtttcctaaggaaccgagagaaaagcaaaaggaggggcacagtttggatggagcatgcatcccgagaagcccctggaagcctgggacactccgggataagtccaggcagacggagcagaaggttagctctaaccaagaccccgacagctgtcgcggtggaagctcagtggaggccccgtgcccttctgacgtcactccagaggatgaccggagcttccagactgtgtgggccacagtatttgagcaccacgtggagagacacacagtggctgaccagtcgggacgttgtctctccaccacaccccctggtgacatggcccatgcccgtgtctcagaacccaggccgaggcctgagatgggctcttggctgggcagggacccaccagacatgacaaaactgaagaaagagaactccagagggtttgacaatcccgagacggagaaattgggaccaaccacccttttgaatggtgaactgagaccgtatcacacgcctctccgggacaaataccctttgtctgaaaaccacaataataacaccttcctcaaacacttggaaaatcctcccacatcgcagagaattgagcccagatatgacattgtgcatgcagtgggagagcgtgtgcacagcgaggccatctcaccggcaccggaggagaaagcggtcacgctccgcagcctcaggtcttggctctcactgaaggacaggcagctgtcccaggaggtcacccctgctgacctggagtgtggtttggaaggtcaggcggggtccgtccaaagggccagtttgatttgggaagctcgaggcatgcctgaggctagtggaccgaagtttgggggcaattgcccgtttcccaaatggacaggcggggcagtggtgagctcgcacaaagccaccgtggcagtcagcgaagagcactgtgctcccggggccacctccgtcagggctatcaaggctgccatctgggaaagccagcatgaggggccagagggggccagaagcaagccaggagtgggagcaaggggcccaccccagggatgccccctcgatcctctttccagggctacgaatgggccttctgactcccaagcacgaacacatccagatgcatttgctgtgcagaaagggcccttcattgtagccgccagggagggtgatccagggccggcccaggtgccacagcctgcagtcagaatgcggaaagccggcgccatggaccagagaatggacagatggcggcggcggactttaccccccaacgtgaaatttgatacattcagttctcttgtcccagaggactctccacatgtggggcacagacgaacagattatgtgagccccacagccagtgccttaagaaaacctcaactatcccactacagggtggagacccaggaggtgaacccaggtgcttcacgggaccagacttccccagcagtgaagcaagggtcacctgtggaacccaaggcgacattttttgcagtcacctatcagattcccaatactcaaaaggcaaagggtgtggttctgtcaggagctgaaagcttgctggaacattctagaaaaatcactccaccctcgtctcctcattctttaacatccactttggtttctcttggtcatgaagaggcattggagatggcaggcagtaaaaactggatgaagggacgagagcatgaaaatgcaagcattttaaaaactctgaagccaacagaccgtccatcatctcttggggcctggagtctggaccctttcaatggaagaatcattgatgtggatgccttatggagtcatcggggatcagaagatggccctcgtcctcaaagcaattggaaggaaagtgcgaacaagatgtcccccagcggcggagctccccaaaccaccccgactctgaggagtcgtccaaaagatcttcctgtgagaaggaagactgatgtgatcagtgacacgttcccaggtaaaatcagagatggctacagatccagcgttcttgacattgacgccctgatggcagagtaccaggagctgtcgctgaaagtccctggggaggctcaggagaggaggagtcccaccgtggagcccagcaagcagctggcagagaccttggagacagccatgggcaccaaatctagccctcccttctgggctctgccaccctcggctccttctgaaaggtatccagggggctctcctatacctgcggatcccaggaaaaaaacggggtttgctgaggatgacagaaaggcctttgccagtaaacatcatgttgcaaagtgtcagaattacctggctgagtcaaagccctctggtcgggaggatccaggcagtggggtcagggtgtcacccaaatcgccccccactgaccagaagaaagggaccccaaggaaatccaccgggcggggagaggaggacagtgtggcccagtggggtgaccacccacgtgactgtggacgggtgccgctggatatcaagagggcctactcagagaaggggccccctgccaacatccgagagggcctgtccatcatgcatgaagccagagagaggaggcgagagcagcccaaagggaggcccagccttactggagagaatttggaggccaaaatgggaccctgttggtgggagtcagggactggagacagtcacaaggtgctgccacgggacctggagaaggaggatgccccccaggagaaggagcgaccgctccagcaggtgtcccctgtggcctcggttccctggagaagccacagcttctgcaaagacaggaggagtgggccctttgtgccaaggggtgtcagaaaggccctggcgggcccctgtgtttatggcaacagtcattcagtagggcagccgcgagcgctgcatgccccacttctattaatccctcagttagcggggcctaaccccagacttgacactcatcagccagtcagccaggacacgcagcgccaggggtacagccaggcagctggcatcatccctccagcggtgccgccagtgcagaggaaccagcccttttgctgcacttttgtcggtcagcaggacccagtgctctggctatgctgtcagctggggctgtcctctgactggtactgtcagctgctgggttcagaaggatccacccctggacccgccccactggacgagaagccagagatgccccgggcggggctcataggaccgagtggtggcttctcagttccccaggcagccgtggccattagtggagccgactggctggtcccctggccaggaaagctggaaaccgtactgtgctcaccacataacctctgggtgctggaaatggagtattactactgccccagcctgctgaagctcttgcgctacctctgggaagagctgagactcctgaacaggaatgaagatcctggatccgatgtgggctttcctccagtcctcaagaaaacaggaagaacgagaaccacttcaacttaccgaatgcctccagtgtgccagggacagggggcaatagcagagactaagacatagaagatttctgttcttataagccttccttagagggacagtaataaataaacaattagggaaataccaagtaattgtaattattaaagtttttcttctctgcacagtggggatgcttgttttgttcccatgagttggtcagagcatatgttaccaccactggtaagaagggtaccgtttttctccccttttaaaggcagagaagggtctgattgcccccagaaccaccgggtggcccagggagataagtcaggcaggggaattaggtgggggcctgccgcctgcctttttccattttagagaaggccagggtttgcagccttgtaagaggcctggctcttggaagaggggctgtaattacag

SEQ ID NO: 466735 - DNA, 553 bp, Homo sapiens
cacagtcattcaaaaggacagccacgttggagctctgccgtgtttggtgatgaaagtatgggcaagggctttacagatgtaatcaaattaagatggggccatactggagtattaggcctaatttaatgactggtgtccttataagaagagggaaatttgtacacacacagaaggagaacaccatgtgaagctggaggcagagattggagtgacacgcctacaaactgaggggcaccaaagaccaccagcaaccaccagaagctggaagaggcatggcacagatgaccacaagagcctccagaaggaaccaaccatgctgacgccttgattttggacttccagcctctcaaattgtgagcaaataaatttttgttgttttaagctacccagttgtggtacactgttatggtagcctgatatagtttggctgtgtccccatgcaaatctcatcttgaattgtagctcccataattcccacatgttatgagagggatccggtgggaggtaattgaagcatggagaaaggtctttcccatgctgttctcatgatagc

SEQ ID NO: 466736 - DNA, 364 bp, Homo sapiens
gcaaactccgcctcctgggttcaagtgattcttctgcctcagcctcctgagtagctgggattacagggacaggaatcagatgggcatagggcatctggtccatgatcatcctttgttcgtgctgatctctgatgaaatatctgaagaagaaggagaacaccatgtgaagctggaggcagagattggagtgacacgcctacaaactgaggggcaccaaagaccaccagcaaccaccagaagctggaagaggcatggcacagatgaccacaagagcctccagaaggaaccaaccatgctgacgccttgattttggacttccagcctctcaaattgtgagcaaataaatttttgttgttttaagcta

SEQ ID NO: 466737 - DNA, 958 bp, Homo sapiens
ctgaaatccagtggggcagtcaaatcttaaagctctgaaatgatctcctttgacaccatgtctcacatccaggtcacactgatcctggacttcatcatccatttcactaccagcattttggtcaaaggaattcaacaagttgctaggaagttacaaactttctcactgttccaacctctgcctgttacccagtttcaaagttgcttcaacatttttgggtatctttatagcagcacccgactctctgtggtactaatttactgtattagtctgtttacatactgctataaagaactgcctaagactagagttaatgaggttggctctgcattcttgatgccatctgtgtcagcaagtaaattgcttggcaatgaaaccatttatcattgtgaacatgtggatggtaagagaagattcccaatgggacttgcaaaataggacttcttcattgatagtgtttgtaaagatgttaatttgctttatttctgtataaaacagtgtcttagctctcatgcctccaattccataagggcaaaaaacttaatcttgcaaaaccaagtatgctcagccaagtctagtttaatactcagtctctttgggacaaatacacaattaactcaagatgcttagcttctcctttttcctttgtttctcctcaagggacaggaatcagatgggcatagggcatctggtccatgatcatcctttgttcgtgctgatctctgatgaaatatctgaagaagaaggagaacaccatgtgaagctggaggcagagattggagtgacacgcctacaaactgaggggcaccaaagaccaccagcaaccaccagaagctggaagaggcatggcacagatgaccacaagagcctccagaaggaaccaaccatgctgacgccttgattttggacttccagcctctcaaattgtgagcaaataaatttttgttgttttaagcta

SEQ ID NO: 466738 - DNA, 1126 bp, Homo sapiens
ctgaaatccagtggggcagtcaaatcttaaagctctgaaatgatctcctttgacaccatgtctcacatccaggtcacactgatcctggacttcatcatccatttcactaccagcattttggtcaaaggaattcaacaagttgctaggaagttacaaactttctcactgttccaacctctgcctgttacccagtttcaaagttgcttcaacatttttgggtatctttatagcagcacccgactctctgtggtactaatttactgtattagtctgtttacatactgctataaagaactgcctaagactagagttaatgaggttggctctgcattcttgatgccatctgtgtcagcaagtaaattgcttggcaatgaaaccatttatcattgtgaacatgtggatggtaagagaagattcccaatgggacttgcaaaataggacttcttcattgatagtgtttgtaaagatgttaatttgctttatttctgtataaaacagtgtcttagctctcatgcctccaattccataagggcaaaaaacttaatcttgcaaaaccaagtatgctcagccaagtctagtttaatactcagtctctttgggacaaatacacaattaactcaagatgcttagcttctcctttttcctttgtttctcctcaagggacaggaatcagatgggcatagggcatctggtccatgatcatcctttgttcgtgctgatctctgatgaaatatctgaagaagaaggagaacaccatgtgaagctggaggcagagattggagtgacacgcctacaaactgaggggcaccaaagaccaccagcaaccaccagaagctggaagaggcatggcacagatgaccacaagagcctccagaaggaaccaaccatgctgacgccttgattttggacttccagcctctcaaattgtgagcaaataaatttttgttgttttaagctacccagttgtggtacactgttatggtagcctgatatagtttggctgtgtccccatgcaaatctcatcttgaattgtagctcccataattcccacatgttatgagagggatccggtgggaggtaattgaagcatggagaaaggtctttcccatgctgttctcatgatagc

SEQ ID NO: 466739 - DNA, 794 bp, Homo sapiens
taacaggagtgtctacctcacagggcggctgctggcatatcacagagatgaggttctcaaaatgcaaagcagaaggtccagccaagagtcggtgcccaaggcaacaaagacaggaggagactcctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggcccctcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcag

SEQ ID NO: 466740 - DNA, 918 bp, Homo sapiens
cgcgctcagcgccttcactgccatccccgctgtccttgccgccccgccatgggcctagagctgtttcttgacctggtgtccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggcccctcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcag

SEQ ID NO: 466741 - DNA, 8213 bp, Homo sapiens
tctgatgattgttttatatagctgttgcaaagagttaattcattctttccttaaagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgacctaagaacaggatatggtgaggatgtcatggaagagaagagctctttccgtggtattctttggcaagagccatgtctactaagaggttaggtgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaac

SEQ ID NO: 466742 - DNA, 2067 bp, Homo sapiens
aggaagaaaccagacaaaatacttctcccaggccagaggaggcggcaccctcagtctgagaagtattgatacgagcagtgaccccgggaaaagagatgacaagtgggttctaacttggacctgaaggggctggagaacaagtggggtcaggccctggtgtggcagaccgaggagatgagacttggcccatccagcagtgccaacggggcaggagagggtgactgcatggccggagaaggaagaaggaacttgctgcttcctgttcccatgagggcacttgagcaatgcttttttgccccacagcagcagcagttccttcctgtagatgcacctgaatccattttgcagttttcccaatacttggaggtccatcttcgctgcatcctcaggggtgttgacactggcccaaagctccatggaagcctcttccctttgttcccccagccctggggcagctcccacctctatagcagcatttcagtgtgtcctagcttggatgctgtggcttcccgagctctgaatctatactgcttactctgggcttatggagtgtgtagcagggaatccttgttgaaggatccccaaacccttgatagccatggacagcccacagtggtcatggagccggagccagaatgtaattcccagtgtgaccaggagctagagtttaagtcaaggcagcaggtattactgatcgaaggaaagttcagtgaagatgctggtagtttacagcactccggagaattaaaacaatgagatgtaaaggtattattgacatttacaatgcgagtcaataacctaggcaatgaatggctgggtcatatagtaggtgtatgtttagctttttaagaaactgccaaagtgttttccaaagtgattgtaccattttacattcccatcatgagagagttccatttgttaattcttggaatgttgctgactattctgaatcctttgcttttccatatgaattttagaaggtacttgtcaatttctacaaaaaaattctgctgggattttaatataaagatttcgttgaatctaaattaattggaggatgattgacatcttaatattaagtcttttcattcatgagcatggtacatctcttcacttacgtaggtttttaaaaatttctatccgcaatgttttgtagttttcagtgtacatattcaggacttgcatatttttgtcagatttattcttatgtgttcacagtttttgaaacttatatatatggaatctttttttaaaatttctatttctgattgttcctagtatgtaaaaatgtaattagtttttttatattgatcttgtattttgcagccttgttaaactcacttattaattttggtaacctttttggtaggctccatttgattttccaaataggaaagattttaatatagggaatcgaaggttcacacaaccgctggaaagtctaatgaaagaagttcaggaaggctcctattattgttgatgaaattagagtgcatattcctagaggagcagtcatgtcagctgcatgcagctatggctttagatgatctggaagctgctgcagaataggaaagtcctgcctgttgttgcctatgtgtctttttgcaactgtttctagagaatattgacttcttttctgctttccagatctaagaagggtacctctccttggtggcagctaacctggaaccctacagggaatgggattctggaaaatatagttccaggccatttcctgaagtgcagggaagatcaggagaggtggtgatggcagtttgacagtctggcactgacggtattaatagagatacataattactcagtcatggaaaagtgacttagcagtattgtgaaaaaacaggagtgttaggtggctgtaactcagtaagatgtgatttccaagaaagcaaatgacctctttaacagtattagcagcggcatatcatacgggacaagtaagtggcaggcccaccctatttggttgccttgcccggtaattggatgagggtagacaaactggaacatgtttaagggataatgatcccagtggtaaggggatagaaaacc

SEQ ID NO: 466743 - DNA, 1570 bp, Homo sapiens
tcaagtgattctcctgcctcagcctccagagtagctgggattacaggcgcacgtcaccacacctggctaatttttgtatttttagtagagacggggtttctccatgttggtcaggctggtctcgaactcctgacctcgtgatccgcccgcctcggcctcccaaagtgctgggattacaggcgtgagccaccgtgcccggccgggaggtcactttaaggagggctgtccaactgcaaggagccgcaagcaggaagtgaaaccacagcacttcaaaaaaagagggagactgggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggcccggtactacccaaacgtcagtcgaatcacaggcaggaggtgtatttccggtttgagaaccacgcagaaatgtgcttcttatcttggttctgtggcaaccgactgcctgctaacaggcgcttccagatcacctggtttgtatcatggaacccctgcctgccctgtgtggtgaaggtgaccaaattcttggctgagcaccccaatgtcaccctgaccatctctgccgcccgcctctactactaccgggatagagattggcggtgggtgctcctcaggctgcataaggcaggggcccgtgtgaagatcatggactatgaagactttgcatactgctgggaaaactttgtgtgcaatgaaggtcagccattcatgccttggtacaaattcgatgacaattatgcatccctgcaccgcacgctaaaggagattctcagaaacccgatggaggcaatgtacccacacatattctacttccactttaaaaacctactgaaagcctgtggtcggaacgaaagctggctgtgcttcaccatggaagttacaaagcaccactcagctgtcttccggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgtgtacagtgatgatgagccattcaagccttggaagggactacaaaccaactttcgacttctgaaaagaaggctacgggagattctccagctcttcttgtagaggctctccatccacctccccagtcctgttcccccagcctgggtgcccctaacttgactcttcccatctccccagcataaccaaa

SEQ ID NO: 466744 - DNA, 975 bp, Homo sapiens
tcgattagaggatcccatcgcgtgacagcatgacggggaggaacagcctcagagatggatggatctgcaatgccatggctgggggtgttccagggcagcctgcaggggtggggctggcactgattgcaactgacagccaggagaccaggcctgggagggcaggcccagggtcaggggagagcctgagtgcttcccacctcttcatctcagactttgcatactgctgggaaaactttgtgtgcaatgaaggtcagccattcatgccttggtacaaattcgatgacaattatgcatccctgcaccgcacgctaaaggagattctcagaaacccgatggaggcaatgtacccacacatattctacttccactttaaaaacctactgaaagcctgtggtcggaacgaaagctggctgtgcttcaccatggaagttacaaagcaccactcagctgtcttccggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgtgtacagtgatgatgagccattcaagccttggaagggactacaaaccaactttcgacttctgaaaagaaggctacgggagattctccagctcttcttgtagaggctctccatccacctccccagtcctgttcccccagcctgggtgcccctaacttgactcttcccatctccccagcataaccaaa

SEQ ID NO: 466745 - DNA, 368 bp, Homo sapiens
tcgattagaggatcccatcgcgtgacagcatgacggggaggaacagcctcagagatggatggatctgcaatgccatggctgggggtgttccagggcagcctgcaggggtggggctggcactgattgcaactgacagccaggagaccaggcctgggagggcaggcccagggtcaggggagagcctgagtgcttcccacctcttcatctcagactttgcatactgctgggaaaactttgtgtgcaatgaaggtcagccattcatgccttggtacaaattcgatgacaattatgcatccctgcaccgcacgctaaaggagattctcaggtgagggtctccctctggcctcatcgtctctctcctctcgcct

SEQ ID NO: 466746 - DNA, 851 bp, Homo sapiens
tcgtgtaagtcctgttagcctgccccaaataacctaatggaacgacaatggatgacacccctccctggggcgctcgctgcgcgcagggcgccgcgctgggcactttggagcgctctctcccggagtcccccccaccggccatccgatgccccatttcagagactggaacggggaggccggccccgcatcgccagttccgcggtgtcacccgcacccaggacagcgacgactcaatgcccgaccctcccggacgcaggaggtcgctgacggccgcttggggacggcggcgtggggaccagcgcgggccggggcagctggtacctgggatcgggcaggacggtcctcttgctggcgcgggcggccggagtcgccttgctcttctccatggccatcaggtaatgatgaagcccctgctctggtccaagctacctgtgaacagcgcccagcgggccgggcccccaacctcgctcctgaacgtacccgcaagcccgccgtgagaattcagcgaagagtaaaggctggagaaagttgcgtgtctcaggctaagcagagcaaagtggggtgagggcttcgccgctaggaacagagatgcccttagggagccccctgatggaagagctctctgcttaagaaggtcagcacgcccttacactcaggtgagaggttttagtttgggtgttgaaatagaaggagagagagtattcctgcccttagggttttacggtcaatacaagagacaattagggagcatctgctgcgagcacgctcgcaccacgagggtgatttagggaagtggaaaagcaagatacagcccaaacaccgaagctggggggtaatttccagcttcccaa

SEQ ID NO: 466747 - DNA, 2008 bp, Homo sapiens
tgctgttggctggctgcgctctctgtaccttagtcacttaggagcggtggcaatttgtaaaaagacagctctggaagttgaagagaccagtggcttcaagcaaaaagtaaattgaaaatgggagatatctttttgtgtaagaaagtggaatcaccaaagaagaatttgagagaatccaaacaaagggaggaggatgatgaagatccagatctgatctatgttggggtggagcatgtacatagagatgctgaagttctctttgtcgggatgatttcaaattcaaaaccagtcgtttcaaacattttgaacagagtcaccccaggctcaaagtcaagaagaaagaaaggccacttccgtcaatatcctgctcacgtgtcgcagcctgcaaatcatgtgacctctatggcaaaagccatcatgcccgtttctctgtctgaggggcgatcgacagatagtcctgtcactatgaagtcttcatctgaacctggttataaaatgagctcaccacaagttgtttctcccaattactcagattcgctccccccagggactcagtgtctagttggagctatggtctctggaggaggcagaaatgagagttctcctgattcaaagcgactttccacttcagatataaacagcagagattccaaaagggttaaactcagggatggaatcccaggggtaccttctttagctgtggtcccttcagatatgtcttctacaataagcacaaatacaccctcacaggggatctgcaactcatcaaaccatgttcagaatggagtaacatttccttggcctgatgctaatggaaaggcacatttcaatcttacagatccagagagagcaaatgagtctggcctggcaatgacagacatttcaagtctagcaagtcaaaacaagacctttgatcccaagaaagaaaatcccatcgtgttacttagcaacttttactatggacagcataaaggagatgggcagccggaacagaagactcacaccacctttaaatgcctcagctgcgtgaaagttctaaaaaatattaagtttatgaatcacatgaagcatcatttggaatttgagaagcagaggaacgacagctgggaagaccacaccacctgccagcactgccaccggcagtttcccactcccttccagctacagtgtcacattgatagtgtacacatcgccatggggccctctgctgtctgtaaaatctgtgaattgtcatttgaaacagatcaggtcctcttacaacacatgaaggaccatcataagcctggcgaaatgccctacgtgtgccaggtttgccattacagatcgtcggtctttgctgatgtggaaacacattttagaacgtgccatgaaaacacaaagaatttgctttgtctgttttgtctcaaacttttcaaaactgcaataccatacatgaatcattgttggaggcacagcagaaggagggtccttcagtgttccaagtgccggctacagtttttgacgttgaaggaggaaatagagcacaaaaccaaggaccatcaaacatttaaaaagccggagcaactgcaagggttccctcgtgaaacaaaagttattattcaaacttcagttcagccaggatcaagtggtatggcttccgttattgttagcaacactgaccctcagtcttctcctgtaaaaactaaaaagaagacggctatgaacactagagattccagactcccttgcagcaaggattctagctgaaaatatgttcgactgacttccaggagttccgaaaggcagaagtgaggctaggccatatgtgcattgtggctgtagatgctagcaagcaatgtcatcaactgtcaggttgtttttcacagtgacatctcatcagctccctattgtcaagaagtagctccaaagtctttgagccctttcccagtcaaatgctcccaacaaggcatcccttattctgacctcagaggtttttcttgtttatgaactttaaataaatggaatcaca

SEQ ID NO: 466748 - DNA, 4222 bp, Homo sapiens
gcctagagggagaaaacttgttgaaattcagagatccccctccccctaccaatacacaccaaatcagacgcctctgaccagatctgaatttggctctcagagatttccattgtagccaggcagttggggcactttctgagtgctgcctccacctcactgtccccagcctgcctgcctccgtttccctagccctgggcctgtgccgctgtcaccatcacctgggcgccctctagtggatgaatcggattatgcacgagggggcttggagcaggattcagaaggggctcctgtccttccttgaaatgctggacgccgggatcctggaacagctcttcaggtctctgcattcctcctggcaacagccagagcctgggcgcagggggctactgttgtttgaaggctgaaggctgcagcctggtagggcactcaggagacctggcagttggctgcagggccaggtctaggggccagggcatgagggatgctctgggctggctcagccccgggcccccatgcggattgtgactgtgggggcatggccacatgatgttgaggggggatctctgaccctgaccttcttggctctgtgcatccttgaaaccagaaaggtctggaacaaatcagtgaacaatgccctaactcggggagggagccacatcctgaccccagcagcctcagaaggatccgtgtcagggttatggggcaccctgggggccccgagtctgcatgggtctccacatgcaacttctgccggaaactctgaaaaatcccaactggggggtcataggacacaatcagaaatgctgatgccactgtgtgtggatccccgggccctggggggtcaggagcatgtagaaggtgggccacagggggttcataagagaatcctgtaaccgcccctgccccccaaacttagaagcccactggagggccatgggtgaaagcttgggggggtgtcctgtggagtgggtggtggggggtctttgggtttacatgctgctgggcctgagcagcaggaccccgtccacagctgatccctgggccctgctgctcagctgctctcttgagtgttgctgtggctgccgagagagcctgagtcgagcctctcttgtgccggccgtacgctgtcaggccacgctggtgagtttggcaaggcacagatgcccagagcagagaactttccttggggatttaatatgtgcgaatcttgaggtccggcaaatctttccctcagctagagagggggtttttgagactagaatcacctcagcatcctcctgtccccagctgtgtccagcctgtctgcagggacatcctgagaggactaggctctcccctcatccacctgcgtaagtgccaccctgaagcctgtccacccatgcttggagaggcttggcctcaacctgcttagccagcagcaggcttgggcctggggtgcagcagagacccaggtggctgtggggtggttgcttcatggggtggttctgaaacgcagttggaagtgcatggacagtgccttacctgttctctgtgggaccctgtttagaaaccaggtctgagttactgggggtcatcgctacattctgatggcctagctgtgtggaggccacggtggagccccatccaaggagccagggccctgggtctagccgtgaccagaacgcatgccctggaggtgtttctcatcttgcacctgtgttgcctggtgtctcaagtggccacaaaactctgtgttagctcttggtgcccctgggcttcggaaccagggtttcccttcatctcagtgacccgggagcatctgggcagtgagtaaagagggtgatttacttgatgggtacgtttggtcctgcctgggagcccccccaggcacggtcctgggacctgaagctgccctcgttggtggaggggagggagagagcttcagggatgaggtggcgttgagctgggcgggaagggtgagcccctgcaaggtggggtgggtgtgctggggacgctgagcagcacggccagcaggtgggtcttcagctcggtacccggtgggacttgtggttggggctggtgtgtggccaggagaggggctggcagaagacaagggggactgtgaggcagctcccatccagcggttgaagcctgatggcctggctctgtgcctcagttctctcatctataaaatgagaaaacagtgccagcctcccagacctgtcatgaggatgaacgagtgaccacgtagcatgggctgggtgcgtgtcacctaacattaccagcctttgcaaggagagccctggggacctggctgagtttttcccttgcctggcccactgcacctgtccccacaggagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagataagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttcaaaaaaaatagacgattataatgagcaaatccggtagacacacatgacggcttttgtgaaatgcttgtgtgaatgtgaaatgtctgttgtccgttgagcttgacctcagacaccccacccgctgtctttccagtgcccgtttgcttagcactctttcttcatttatagtgcaaatataaacatccaggacaaatacaggaagaccttttttttttttttttttttttttttttttttttttttttgagacggagtcttgctctgtcgcccagggtggagtgtgcagtagcatgatctcagctcaccgcaacctccacctcccaggttaaagcgattctcctgcctcagcctcctaagtagctgggtttacaggcatatgcaaccacacccagctagtttttttagtagagacagggtttcaccatgttggccaggctggtcttgaactcttgacctcaggtgatctgcccgccttggcctcacaaagtggtgggattacaggcgtgagccaccgtacccggcctagaaagactttttgccttctaaagaagggtttaggggcacgctgctagctagggggagctgtggccgagtacaatgccgggcgtggggagccaggcggccccggggctgaggcgagcgaaggggctgaagggagt

SEQ ID NO: 466749 - DNA, 1637 bp, Homo sapiens
cctgcccccgtcacaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagataagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttc

SEQ ID NO: 466750 - DNA, 2208 bp, Homo sapiens
cctgcccccgtcacaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagataagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcgggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttcaaaaaaaatagacgattataatgagcaaatccggtagacacacatgacggcttttgtgaaatgcttgtgtgaatgtgaaatgtctgttgtccgttgagcttgacctcagacaccccacccgctgtctttccagtgcccgtttgcttagcactctttcttcatttatagtgcaaatataaacatccaggacaaatacaggaagaccttttttttttttttttttttttttttttttttttttttttgagacggagtcttgctctgtcgcccagggtggagtgtgcagtagcatgatctcagctcaccgcaacctccacctcccaggttaaagcgattctcctgcctcagcctcctaagtagctgggtttacaggcatatgcaaccacacccagctagtttttttagtagagacagggtttcaccatgttggccaggctggtcttgaactcttgacctcaggtgatctgcccgccttggcctcacaaagtggtgggattacaggcgtgagccaccgtacccggcctagaaagactttttgccttctaaagaagggtttaggggcacgctgctagctagggggagctgtggccgagtacaatgccgggcgtggggagccaggcggccccggggctgaggcgagcgaaggggctgaagggagt

SEQ ID NO: 466751 - DNA, 1699 bp, Homo sapiens
cctgcccccgtcacaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagataagatcgaggtgaggctcccatggaggtatttgatcctggaggcctggccctgcccggctgtccctgggctcctaagaggccaggcccggccaccccctgcagcctgacatacgtatcaccaaggcaccaatgggtgcctgtgctctgctatttggccaagcggaatgcttgataaagtagttacagtactttctgacaaaaacgccttgagagggtagcgctatacaacgtcctgtggttacgtaagatgttatcattgggccaggcgcctgtagtcacagctacttggagactgaggtgggaggatcactggagcccaagagtttaaggccagcctgggtaaaggggacacgggaaacctctgcactgcttttgccacttactgtgagccttaaactatttcacaaacaatacaaaatcaagacaaaaaattaataacatatccactgcccccacttaagacataaaacatgagtgtcattgaagccagaggcagccattggcctgagtttgttgattcgttcccaagcagttgaagacagttttgtttttctgtggatgtctgtctcttctccctatgctgggtgcagccctgcattgccactgtggttggatttcagtggccttgtcctgtgggcgtgctttgctatttgcgccaagcggaatgcctgctaaagtagttacagtactttctgaccaaaacgccctgagagggtagcgctatacaa

SEQ ID NO: 466752 - DNA, 3563 bp, Homo sapiens
gcctagagggagaaaacttgttgaaattcagagatccccctccccctaccaatacacaccaaatcagacgcctctgaccagatctgaatttggctctcagagatttccattgtagccaggcagttggggcactttctgagtgctgcctccacctcactgtccccagcctgcctgcctccgtttccctagccctgggcctgtgccgctgtcaccatcacctgggcgccctctagtggatgaatcggattatgcacgagggggcttggagcaggattcagaaggggctcctgtccttccttgaaatgctggacgccgggatcctggaacagctcttcaggtctctgcattcctcctggcaacagccagagcctgggcgcagggggctactgttgtttgaaggctgaaggctgcagcctggtagggcactcaggagacctggcagttggctgcagggccaggtctaggggccagggcatgagggatgctctgggctggctcagccccgggcccccatgcggattgtgactgtgggggcatggccacatgatgttgaggggggatctctgaccctgaccttcttggctctgtgcatccttgaaaccagaaaggtctggaacaaatcagtgaacaatgccctaactcggggagggagccacatcctgaccccagcagcctcagaaggatccgtgtcagggttatggggcaccctgggggccccgagtctgcatgggtctccacatgcaacttctgccggaaactctgaaaaatcccaactggggggtcataggacacaatcagaaatgctgatgccactgtgtgtggatccccgggccctggggggtcaggagcatgtagaaggtgggccacagggggttcataagagaatcctgtaaccgcccctgccccccaaacttagaagcccactggagggccatgggtgaaagcttgggggggtgtcctgtggagtgggtggtggggggtctttgggtttacatgctgctgggcctgagcagcaggaccccgtccacagctgatccctgggccctgctgctcagctgctctcttgagtgttgctgtggctgccgagagagcctgagtcgagcctctcttgtgccggccgtacgctgtcaggccacgctggtgagtttggcaaggcacagatgcccagagcagagaactttccttggggatttaatatgtgcgaatcttgaggtccggcaaatctttccctcagctagagagggggtttttgagactagaatcacctcagcatcctcctgtccccagctgtgtccagcctgtctgcagggacatcctgagaggactaggctctcccctcatccacctgcgtaagtgccaccctgaagcctgtccacccatgcttggagaggcttggcctcaacctgcttagccagcagcaggcttgggcctggggtgcagcagagacccaggtggctgtggggtggttgcttcatggggtggttctgaaacgcagttggaagtgcatggacagtgccttacctgttctctgtgggaccctgtttagaaaccaggtctgagttactgggggtcatcgctacattctgatggcctagctgtgtggaggccacggtggagccccatccaaggagccagggccctgggtctagccgtgaccagaacgcatgccctggaggtgtttctcatcttgcacctgtgttgcctggtgtctcaagtggccacaaaactctgtgttagctcttggtgcccctgggcttcggaaccagggtttcccttcatctcagtgacccgggagcatctgggcagtgagtaaagagggtgatttacttgatgggtacgtttggtcctgcctgggagcccccccaggcacggtcctgggacctgaagctgccctcgttggtggaggggagggagagagcttcagggatgaggtggcgttgagctgggcgggaagggtgagcccctgcaaggtggggtgggtgtgctggggacgctgagcagcacggccagcaggtgggtcttcagctcggtacccggtgggacttgtggttggggctggtgtgtggccaggagaggggctggcagaagacaagggggactgtgaggcagctcccatccagcggttgaagcctgatggcctggctctgtgcctcagttctctcatctataaaatgagaaaacagtgccagcctcccagacctgtcatgaggatgaacgagtgaccacgtagcatgggctgggtgcgtgtcacctaacattaccagcctttgcaaggagagccctggggacctggctgagtttttcccttgcctggcccactgcacctgtccccacaggagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagataagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttc

SEQ ID NO: 466753 - DNA, 1549 bp, Homo sapiens
cctgcccccgtcacaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagataagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcgggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttc

SEQ ID NO: 466754 - DNA, 1751 bp, Homo sapiens
cctgcccccgtcacaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttcaaaaaaaatagacgattataatgagcaaatccggtagacacacatgacggcttttgtgaaatgcttgtgtgaatgtgaaatgtctgttgtccgttgagcttgacctcagacaccccacccgctgtctttccagtgcccgtttgcttagcactctttcttcatttatagtgcaaatataaacatccaggacaaatacaggaagaccttttttttttttttttttttttttttttttttttttttttgagacggagtcttgctctgtcgcccagggtggagtgtgcagtagcatgatctcagctcaccgcaacctccacctcccaggttaaagcgattctcctgcctcagcctcctaagtagctgggtttacaggcatatgcaaccacacccagctagtttttttagtagagacagggtttcaccatgttggccaggctggtcttgaactcttgacctcaggtgatctgcccgccttggcctcacaaagtggtgggattacaggcgtgagccaccgtacccggcctagaaagactttttgccttctaaagaagggtttaggggcacgctgctagctagggggagctgtggccgagtacaatgccgggcgtggggagccaggcggccccggggctgaggcgagcgaaggggctgaagggagt

SEQ ID NO: 466755 - DNA, 1301 bp, Homo sapiens
agctccagagagcatgtggtcagtagtccctccagccatgcagatcctgccactgatcaaaggacagccccgtggtgagagctgtggcctgaggcagggaccacagcacacaagcatcaggaagctgtccctgtcctggatgggaaaccacagggcaggtttcctgttggaattcatggtggaaagggaaggagctgagagagaagaattctcaaggccgcgctgcagcaagcctcttgcaccggtgctgggccccggtgagcctgaggagcaggagaccaaggatcagcccagaggtccccaagaccccttccctggaggcgtcacctgtgtcctgagtgaggagagtgaggagcagcagagcccaggccatggtggagacgtcccgagagcgctgcctcttgtgaccccagcactggccctgccccagccctgtcttatcccctttgcctcagaggagggcggggcctccatgaaaatcagcatcctgggctcctctcctcaccccaccctcaccatctgcaccatcgaatccctggagcacatcagccaccccaggcagtgcacccacatccacacggggcacatgtgggagggaccctctggagggacacagagcaccgaccagggccacagtcctgaacccaagccagctgctcccaatcctgcccttcccactcatgagcaggaaatcaagagccatgatttggcagcttccccaggagagagtccggaaagaccagggacaatgaaagtggaggagcagccaggaaaggagaagccactgtgtctgcaggacaggggctcccagagcaaaggggagataaaggggacacctgtgacctcagggaggacactgcacatggcagggacaccattttagcacaactgggtgtgtgaggagagggcactgtgagaagtcaagtgcctggagctgtggcagagaaagaggcagcatctgcaagagctgaaggtgtgagatcatggtcactggctcctgctgcatgtcagcgtctccctgtcacccaggcccgccccatcgccaggtggctttgccaggtaactctctgcttccccctggtggccgctccacactgtgggctgggggctcagggacttcctgggtctaggtgtggattcagaacctgctgttcaggtccctgatgccctgatccgaggactgctggtcccaggggaggaacacctcttctctgtgtggcccctgcctgactcaagatcaggtacaaggggctcagcttacccaataaaatacaaaagtatatatgtagaaacactgaaat

SEQ ID NO: 466756 - DNA, 1161 bp, Homo sapiens
ctgccagtggtatgatgtccgagccttctcccaccctgctactgcctgctcaggggtcctgggctgccctgaggccaccgcctagcaagatcaagatagggcttgagcggcagtgggatagggcagtgggggttccgggggggtccggtgcaggcagaaccaagagtgtgccggcggagggctgtcggtacagggtgcagggcgtggcggctgcaggacctcagcttgcctctttaaatcccttcctgggcaccgcggtggcccggccctttcccctcgtgctgtttctgctggaaacgccgcacagtctcctcgggggcagccgccagcggaaacgagggtgtgtgtgtggctgccactattctgcagacacgctggctccaccccagagagttgcagggccaggaaatctgcatttaaacagaccctggctctcacacttcggaaactgcccgaagcacctctcaaatatgggacaggtttgatactccctccccctctccgttcccccgcttctcccttcttcgccctccttcccacttcctccctcctccccgccccttctgccccccacctgccctccctccctcccttccatccttcctcctcctcccggcaacctttctcccttccccactccctcccctctccctcctccttgtgcttaggccgaaaatcaggaatctcttgaatgaatgcatgaaggtggagccctttcccttaatgcgcaggtgaaaagggcacctcggtggattctactaaatttaatagaagataaataaattaaataaataaataaatataatttaatataaataactagaaatttttcaatacttgcatctctgtaggttacctctggaagtgcagggctttgtctttttggattaactcagaaattagaccttcagaaaacaacatcagctctgattctctgcacccttgatgctgccggtggcgactgcggcttcctgatggaaatgtagacctgaacataagtcgcagaaaaatgcagacttgagttggagctaagctgactcaggtattttgagatctataatctgagtggggagcagagagattccaagatatttgcattcagtggcttttgcacacagcagaacctgtgctgagggcatttctagggtcattactcataat

SEQ ID NO: 466757 - DNA, 3410 bp, Homo sapiens
tctagtccacagaggcttcacttaaaagctaggagtgaaccaggaattgagaaagtaggaaggaggtgtcccagaccccaagctaggaatggggagggaaatggaggaatcccaaatgccttaaggacggcctacatactaaggaaaatttttttctaactcctggttgcagctgaggggagcggctgagggcggggacaggggtgcggcggacccactgctcccattacccgaccagcgcctcccttcctccttggatgggtgcccctgtcttgctaagaactgcctgtttacacaactgctttccttgtgaaaatttaaaggctcctattcccagttgttctatccttgtaggttaaagattatgtcaaaaactatattgcattatctctttccttctccttcccattaagacggaaaaaacatccgggagagccggtccgtttctcaggcagactaggccattaggtgcctcggagaaaggacccaaggctgctccgtccttcacagacacagtccaatcagagtttcccaggcacatcgatgcaccgcctccttcgagaaacaaggtaactttcgggttctggttgtctccaaagtcatccgaccaatctcgcaccgcccagagcgggcccttcctgtcaattacctactgaagggcaggcggccagcatcgccatggagaccaacacccttcccaccaccactccccctttctctcagggcccctgtcccctccagtgaatcccagaagactctggagagttctgagcagagggcggcaccctgccctctgattggtccaaggaaggctggggggcaggacgggaggcgaaacccctggaatattcccgacctggcagcctcatcgagcttggtgattggctcagaaggggaaaggcgggtctccacgacgacttataaaagccgaggggcgcgcggtccggaaaacggccagcctgaggagctgctgcgagggtccgcttcgtctttcgagagtgactcccgcggtcccaaggctttccagagcgaacctgtgcggctgcaggcaccggcgtgttgagtgtccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcatggtcccaagggagggtctgggtcaggccccaccattgaggaggtagattaggggcctttccagattgctgtttttgttttggagcttcaaaactttgcatttcctagtatttctggttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtgatgccttttattcctttatttgggggtcagtagggtctgcataggttgtttttcccatagc

SEQ ID NO: 466758 - DNA, 805 bp, Homo sapiens
  misc_feature (751)..(751): n is a, c, g, or t
  misc_feature (777)..(777): n is a, c, g, or t
  misc_feature (786)..(786): n is a, c, g, or t
agtcattaaaaagtgttcttataggcatgtgtgtcataacattggtttagagtacatttgcttagaataaagtaggttgtgtatagcatggtgaaaaatgagggctcttaagccagactgcttgaggttgaatctcactttgagtactctgtgactttgtgcaaattgcttacccattctttttgcctttcttgactgtgaattctgagtattaataggagctaccttatagggctgttaggaagatgaaataagttaatgcatttatgttacttattaagtggtcaacaagttagctattattaatgtaaaaacattaacctgctcttgaaaaaatatgttttcttctctttagtggcacactgtgcatcttctcgacaaatcatttcacactggaagaattgtacaagacatgattgtcctgtgtgtctccccctcaaaaatgctggtgataagagaaatcaacagcgtaagtgatgaaatcttttgaaggtttatatgaaaagttttaaagtctcaccagtgccatttatagtactacttgattatgtgagggacctgtggtgttgtactatgttgaataaatgtttttttcccttttaatttttctgcttccctagtgcatagaattgaactgcttagggagtttgaggctgcagtgagctatggtcatgttactgcgctccagcctgagtgatggagtgagaacctgcctcaattaaaaaaaaaaaaactcgaggggggtgctgcnacggagcctacaacgctatcccatgngggcttganaggaggcagagcgagcgtg

SEQ ID NO: 466759 - DNA, 1611 bp, Homo sapiens
  misc_feature (1557)..(1557): n is a, c, g, or t
  misc_feature (1583)..(1583): n is a, c, g, or t
  misc_feature (1592)..(1592): n is a, c, g, or t
tgtggtagtttttgctttttagttttggtgtaacgtgagacttcagagatacagtggggttggtatacatgtccacacagttttcccattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagcgtaagtgatgaaatcttttgaaggtttatatgaaaagttttaaagtctcaccagtgccatttatagtactacttgattatgtgagggacctgtggtgttgtactatgttgaataaatgtttttttcccttttaatttttctgcttccctagtgcatagaattgaactgcttagggagtttgaggctgcagtgagctatggtcatgttactgcgctccagcctgagtgatggagtgagaacctgcctcaattaaaaaaaaaaaaactcgaggggggtgctgcnacggagcctacaacgctatcccatgngggcttganaggaggcagagcgagcgtg

SEQ ID NO: 466760 - DNA, 847 bp, Homo sapiens
  misc_feature (793)..(793): n is a, c, g, or t
  misc_feature (819)..(819): n is a, c, g, or t
  misc_feature (828)..(828): n is a, c, g, or t
gcggccggttcgtggttgtgggttgacgtggttggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagcgtaagtgatgaaatcttttgaaggtttatatgaaaagttttaaagtctcaccagtgccatttatagtactacttgattatgtgagggacctgtggtgttgtactatgttgaataaatgtttttttcccttttaatttttctgcttccctagtgcatagaattgaactgcttagggagtttgaggctgcagtgagctatggtcatgttactgcgctccagcctgagtgatggagtgagaacctgcctcaattaaaaaaaaaaaaactcgaggggggtgctgcnacggagcctacaacgctatcccatgngggcttganaggaggcagagcgagcgtg

SEQ ID NO: 466761 - DNA, 500 bp, Homo sapiens
ggcgacagaatatgcagtacccaaacccaggcatgggaagtgctggcaacttactgactgagcctcttcagcagggctctccccagatgggaggacaaacaggattgagaggcccccagcctcttaaggtaagtacagttttggtttgtgtgcacaatcggcatgcatgtgagtattgtcatgatggatggagggtttgccttacattgtatagcagtttccactattacacgccaggaatttactgtgctgtcataagttttaagaagtgcctgtatttaagtaaaacgtttattttacagctggtattctataacttcatacttccaaatgattgctggctaatgctggttctctctggcacaagtattggaatgtttttatctcatttccaagtccagtttagccttgtagcctccttataaaattacagttttgagatggctggcattacactgtcttcagatggatactccatttgttcctattgctttgaatgt

SEQ ID NO: 466762 - DNA, 1180 bp, Homo sapiens
tgtggtagtttttgctttttagttttggtgtaacgtgagacttcagagatacagtggggttggtatacatgtccacacagttttcccattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatggtgagtactaatccattacagacttgttttcaaactggcattttgacaaaagaattgtgttaaactttcacccttctgttatatatgctgggatttgtacccactaggagcctaaattgatatgtacttgatgatccctgtgaggaggcttgtgcttcctttccatttctctgttttttttgttccatgtggttattgatcagtgagcatgttgatccaaacaggagtaagtgaactgctacaatgaagttttaggggcctgccattcagcaacttggtct

SEQ ID NO: 466763 - DNA, 303 bp, Homo sapiens
ctctagaggatccggttgaagtagattcctctctaaaaaagattttgttaactatttctctcccaaagagactgtttaaccaatttttaggtacggaattacaacctgaaatcaagccttcatttccctctcaacttaattaccacttcctataagaacttgattatatgtctgagaaccgagatagtaaaatgaggagtctgactgaacaatcgagattactaccattggacaaaccctgagaggaatctactcttcaattctcctggctttcgttatcaattatatgatattaaagagaga

SEQ ID NO: 466764 - DNA, 881 bp, Homo sapiens
ggtgatacaagatgaggtttgagagaaagctgagaccagcagtgaaatcaaggaccgcacagttcgggcgctacgagagctgccgttccaattccatccgaaggaagggagacaacgctttcccgcgcggacgagcggccaggcgcggcgctaactgcttggacgccccgcctgccaccgtgcctcagctcgcctcttctgcacaacgggactctgccccacagggacaccgggaaggtcccgacccgagcgctcagtgggacggggtcgcaccaagagtccgcgcggaactcccgatctgggcggggcccaaaggtcacgtggccgggaaggcgggcgcgcgggctgcgagcaccaaccgccggccgccccgcgctgcgtcgccccgcctcccccgccccacccccggtggaaggctgcgggcgtcctaccagtgccaggactgccagagcgggaggagcgcggcgcgggccagccgggactgctggacagcggggtccaggctagaggcgagcgagcggtcagtgacggctgtggaggagggaggcgctgggcgtcagcgcgggacccgagcctctggaccactgagctggggggctggctgaggtccacctcctaacaaattattggaaggaatatgagaaaaagactgtttaaccaatttttaggtacggaattacaacctgaaatcaagccttcatttccctctcaacttaattaccacttcctataagaacttgattatatgtctgagaaccgagatagtaaaatgaggagtctgactgaacaatcgagattactaccattggacaaaccctgagaggaatctactcttcaattctcctggctttcgttatcaattatatgatattaaagagaga

SEQ ID NO: 466765 - DNA, 1112 bp, Homo sapiens
ggtgatacaagatgaggtttgagagaaagctgagaccagcagtgaaatcaaggaccgcacagttcgggcgctacgagagctgccgttccaattccatccgaaggaagggagacaacgctttcccgcgcggacgagcggccaggcgcggcgctaactgcttggacgccccgcctgccaccgtgcctcagctcgcctcttctgcacaacgggactctgccccacagggacaccgggaaggtcccgacccgagcgctcagtgggacggggtcgcaccaagagtccgcgcggaactcccgatctgggcggggcccaaaggtcacgtggccgggaaggcgggcgcgcgggctgcgagcaccaaccgccggccgccccgcgctgcgtcgccccgcctcccccgccccacccccggtggaaggctgcgggcgtcctaccagtgccaggactgccagagcgggaggagcgcggcgcgggccagccgggactgctggacagcggggtccaggctagaggcgagcgagcggtcagtgacggctgtggaggagggaggcgctgggcgtcagcgcgggacccgagcctctggaccactgagctggggggctggctgaggtccacctcctaacaaattattggaaggaatatgagaaaaatggagtttcactcttgtcacccaggctggagtgcaatagagcgatcatggctcactgcaacctctgccccccgggttcaagcgattctcctgcctcagcctctcaagtagctgggattacaagtgcccaccaccacgcccagctaatttttgtatttttagtaaagatggggtttcaccacattggccaggctggtctctaactcctgacctcacgtgattcatccatctcagcctcccaaagtgctgggattacaggcatgagccactgtgcctggcctatacttatattttcttctgtgattttaatattttagtgtttatgttttggtctatgatccattttgagtaaatttttatatttggtataaggtaggggtccaactttatttatttttgagatggaggcttactctattgcccaggcaggcatgcaatggtgcgatccagctcactgcaacctctg

SEQ ID NO: 466766 - DNA, 1964 bp, Homo sapiens
agcgggtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaaagaaatgccgtcacaccagttcgtttccagcatgagtgcttctgctgatgtgttggccctggcgaaaatcgaaatcaagttatccgatattccagaaggcaagaacatggctttcaaatggagaggcaaacccctgtttgtacgtcatagaacccagaaggaaattaagcaggaagctgcagttgaattatcacagttgagggacccacagcatgatctagatcgagtaaagaaacctgaatgggttatcctgataggtgtttgcactcatcttggttgtgtacccattgcaaatgcaggagattttggtggttattactgcccttgccatgggtcacactatgatgcatctggcaggatcagattgggtcctgctactctcaaccttgaagtccccacgtatgagttcaccagtgacgatatggtgattgttggttagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagccactgttaagcactgttatgctcagtcatacacgcgaaagggacgcagattctgcaaggtcattgttgggatgaagtaaaattaacgggtcatctaaaaaaaaaaaaaaaaaaaagaaattcaaaaagtagttgcctctggagaggagggaaagcaagcagggatgaaggaactggatgaggtgattaaaatgttctttattgtgctatgggtgatggttccactcatccaaattcatccaactgtatacttaagatttaagtatgtcataatatgtaaattatatttcaataaagtggttagcataaaactattttaaaaagtaatttgtagtgaagaaagggaaatttttgtattagtcaactctgacatttctattttttatctttctaaaaaaagtcaattgctttaaatttgctaaaggtataaaaatatcaaggtattaatcattcattcatcaaatatatattgagtgatcctaccccaaggcaaggtactaagtgctaggaacactgttcttgcccttgaaaaattcagagttttgcaagggataaagatgtgtacataaatggactgtgacagaggcatacagacattgtaggcataaaagagagaatgtcagactacctgcgaatgttaacgagattcaggacgatcacttgggaaccttgaatcacctgtggtaactatggtgcccactcctgtgaggttgagcctaaattgtaatgggtcttaacctaagataaaagagactgacccagccttgccaactgtttctagctgtccacccaagaccttcaaattagtgaaggatttttaaagcctcaagagccacaataaagagcacatggtgcatgcttcttgccatccttgacctaaacaacttagaaac

SEQ ID NO: 466767 - DNA, 899 bp, Homo sapiens
tcagctggtagttccatctgccattgctgtgccagatgaagaccctgatagaacacaccaccatgcatggctacaggtgcacagcaggcaccatcaatgcagaaactcattctattcctctcagaacaggatcagaaacggtgtgcatacaaggagagaacctcctagggctctattctgtatttggatcagatgtgcatgagggggccctgtctattggaagctttggagccatgaacatcgcccactgttttggagcccagagcagggaggttctgcaccaggttcaggcagggatacaggacagcatcggacattcagtgaccaagcagccagaactgccagattcccccgtcgtgtgctcaggcagaccccagcagcgatccctgaatggagagtgcaggataaactgtagctcttctgtgaaaaacagttccagagaaatgcagttgtaccctacatgtactcctgcttcccatgtatactgaaaacgagattgattccgtcaccccaataagcacagctgcactgtaattggaagtaccggatttctgccactaaacctcagttgtgtacttaaaaaaccatcaccatcatcactgtcattataatttttctattaccattattttaatttcctaacgctgatccatgcttgtggtgggaggtagcactagccttttttgttttaatgaaatttaagacttcttggacaatgttgaatagcagctgtgaaagcaggagtccttgttttgcttctgatctttgtggggaggctttcactctttcaccatttactgtgagattcactgtggattttgataaaggcccttctttaatcaatttgtgcaggtttccttctgttcctagtttgctaagtgtttttgtcttgaaagtgg

SEQ ID NO: 466768 - DNA, 2597 bp, Homo sapiens
gatggggtttgctgcattgcccagactgatctcaaacacctgggttcggttgtcctgccttggcctcccaaagtgctgggattacaggcatgagccaccacacccgaacacttggggtggttttaagcccccagcaagatgcaccagcaggaccaggaggtggcctgggcaccccctatcactcccatccatgcaaacctagaggaccgaagcagagggtgctgtttcaacgccaccaccaggagagaggcagaggggctgtgccatgctagagtcctcagggagggagtgacctcgaccctggctgtgctgcaagctgactccagccttggggtcagcagcacctggcgaacagcagcaggaggagccgctagagcagctgctcatgggcagagcagcccttgggcaactcctgccaccaccccctccccagggagcccaaggcaggggaggctcagcatggaatgaaacagcggagtgagggacacaaggagcctccgagggcagcagtgcacatgggggagacatctcccacgaggccaaggcctccagtgctcaccgatgccctctgtgaagttggggtagaactcgtcagtgaaaaggggctcgggcagctcacggaagtacagcttcagcatgcctgcgatggcgttcacgtccatctcgctcatcatcaccgacacgtccttgttatctggaaagagcatggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccgacactcactgacgttgaagcctgccttcagtgcctggatgtccgtggccaccccagacatgcggtagatgcccacctcctccatgcctcggcgctcgatctcctccacacactggcgcacgatgtagggcaccttggacctctctctcctgcgggaggagggaatgttctcagtgtcctaacagccctgcttgggccataacacaggagacctgctccctatgtgcacacccggaggtggggtgaggacggtgacgaaggtacccaggtctggggctgcacacagagccttctgcatgcctgtcctccctctgcaagctctgtcctcatggcatgtactttctcaggaacctttcaagcggccagaacccctgcgaatcacacatgacctttgcgggaagaaacagctgaagggacaggcaccctcagtgcgtgagcccaagcccctccccactcacttggtgaccacagcaatcttgactccgaagacccctgtctgttttcgggacggcatcctcttcaagctgaacttcctgctgttgaacttgaccgagagctttacttcgatctacagtggggagaaggggcacagtcctctaatccttctggtcctcatagcccaaggtcccaaggacccctgggatgggcgccaggagagtcccacggacacgtaccccattcatggcgatgacggcgcgctgccagtctctgtcctgcagggcctgtgggtccagctgaaaggaaggagtcatgattggcagaggccctgggtgaaaggcgagctgtccagcagcaacttcagtaacaactcctgggggcctggcatccacagctgctgtctggggaattccagcactatccaggcagctagcctgcaggagcttgtccttaatgtcacccgaacacagtctgtcctggtatgtaacaccctgactgtcatgaccaagccacatgtcccccacccaggaacgctctgtttcccactttatggggagcacaagctctatgtcagcggttcctgggtcctactggttaacgtttcccaaggctctgaactgtgcagccagagtggcacagagaagcaaagggcggcgggacgtctcccaccgggggccatgtggccacaggctctcattccgcacctggccctgaaggtcgtcagaggccacactccaggcctcagggaccccaccctgagaagcagcatctgtgagcagggagcgaacagccatcactgggcccctctccccttgaaaactcagaactggcagaagcagctaacaagcaacccagagtccagtgctccttctcctcctgcttatccagtgccctaggtccctcttttcacaaccctctactctttagtcaggtgtactgcccttcctgagttctggggacagagttttcccatttctcaaaatctatgtatcatagatttcccaactgtaaaacggagggataatgaacaactcatagagttgttgagatgaagggaattaataaatatgaagtacttggaagactgcttgatatgtattaaacacatatgaatctttactcctcctgctagtattactaccctaatcttcatccttattcttagtgcagaacaaaggcactagagatagaagaagcaggaaacgaacctcagagcatgaccttccagcccctccctgccctgcctcctgcaccctgctccatctgttccccctacccaaggtctttggggtccctcttgttttcatttgc

SEQ ID NO: 466769 - DNA, 2181 bp, Homo sapiens
cccaggggcccagtttcctatgaaatgggagcatgaagttgaagtgagggctgagcagaggggagcagacacgctcggggactgtctatgggcattaaaaatcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccagatgccaccagggccactggccccagcttcctccttcacagctgcagtgggggctggggctggggcatcccagggagggtttttgtatgagcctgtgtcacagtgtgtggtattcggcggagggaccaagctgaccgtcctaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccagatgccaggtccctgccatggcatccctgaccctatgcaacaagccagtgactctgtgtcctccagaagcctggatttccagggatcctgctgtgggtcacaggatgtcaccggtcccctctctctgtgggttaagtgtgggggccatgtggactccctcatgagcagatgccaccaggaccactggccccagcttcctccttcacagctgcagtgggggctggggctaggggcatcccagggagggtttttgtatgagcctgtgtcacagtgttgggtgttcggcggagggaccaagctgaccgtcctaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagccttccctgggttctcaatttatggtggagggaattctgcacccagtgggaaagtcacccaagggaggaggcttacagcctccccgagtcatctctctggaaggtccttcctcttccagtcaccccttccccaactctccaccatacccctgagcctccagcctggcctcagctcagaccagtcccacaccctcctcaattttacttctcaataaagacctgatcatgtaaaacccagtttccaatgtgtcgtctgtgtctggtcatgtgcctgtgctgaagggtcactgctctgggacaggaggcagtttcaggtgagatcccatgtccccgtcaccccacaccccacccaacctgccaggaaaccgggtgagctccctgtgccagggggaaccatgttccagagcagaaagttgtccctgcagagtggtccctgaaatgcagttcttgcccacctgggaaggatgtggagcctagtgaggacagagtggtggccctgagcagggcatc

SEQ ID NO: 466770 - DNA, 976 bp, Homo sapiens
gacagcacccactcctgtcctggtcctgacatggtggagctgtggacaggaaggactgtagcctgggagccagctcaggatggcggcctggggcctggacagcctcctggagccagagactcccaccttcccaaccccaggaccaggctcatgggacctgcagactgtggcagtgccggggaccttcctccccacaaccctgattggctgcaggcacacaccctgggtgactgccctgagcccgagacccaagggccagcctgagcccctcagccctgaggtgcccctgagctctgggcttctgtccacgctagcttggggcagccccaacagcagcagcagagttcctgaggcccagcccccggcccccagcctggctgagacggggcccccgcggacctgctggctgccaggaacaccagctggcgagcgggaagctggagcaaggcaagtgatgtgggctgttgggtgggcggcgagtttgcacgggaccttggtgactgtttcctcatctgaaaatgagcagagtgggacacgggcgctgtctgtcctgtttcccttggggcgggggttcctaggattaggggaaactgacagctgtggtaggtggaggctccatgaggaaccttgccacacccccacctgtacctgcacctgcacctgccagctgatagatcgagtcaggcaagagagccccaagcccttcgacctctaaacagatccctcctcttctcggtgacctccctttcccagcctgcctggacggttgttctgtgacttaacagtggctcccccagccccaaagccagcccccttcatctgtgacttagtctgctgtcgtggtgagctgacacatccaggtgtgaccactggtgaaaacttgtgcctctgttgtacaccctgccctgttctataaatatctatcaatactcatatatagacacacctacacatggccgaccgcctcgcctctagc

SEQ ID NO: 466771 - DNA, 7557 bp, Homo sapiens
  misc_feature (68)..(68): n is a, c, g, or t
  misc_feature (70)..(71): n is a, c, g, or t
  misc_feature (73)..(73): n is a, c, g, or t
  misc_feature (80)..(83): n is a, c, g, or t
  misc_feature (85)..(86): n is a, c, g, or t
gttgcaaacacgttctctatcgtgcttaattgccagctgtgaggggttagctacatcagtttacagcntnnanagtgccnnnntnnaggtgtgcactgccttgcctggctaatttttttttttttttgagacagagtcttgctcagttgtccaggctggattcaagaccagcctggccaagatggtgacacctcgtctctactaaaaatacaaaaattatctgggcgtggtggtgggcgcccataatcccagctactcaggaggttgaggcaggagaattgcttgaacctgggaggcggaggttgcaatgagcctagatcacgccaccacactccagcctgggcgacagagtgagactccgtctaaaaaaaaaagaaaaatatactatctaatacatatagcatacaaaatatatgttcatggactgttgatgttatctgtaaggcttcccatcaacaataagctattagtggttaagcttttggggagtcaaaaattatatgcagattttctactgcatggcggggcagcattcctaatccctgtggtattcaagggttaactgtatttcttggtgaccttggacaaattgttgaacttctctgtaccgtggtgtccgaagtaaagtagtccattcaggcacagtgctaggacaccacctggcctatagcatgtgctcggtcaaagttaactctactgtaattcctgcttgggttgttctggggatacctaatttctccccaccagccacttccccaagaatagtgagtgtgagggtccttacagacagggagatgagagcgtcactcctctttatgaccgtcaaagctctgcaggtgctcgcccttcgggtctctccagcctcacctggtacccctctcccccttgcttgctttctgcagccatggtggccttttattcctcagacccgttttctttcctgtcccaggaagggcctttgcaggtgctcttcccacagcctgaaagttcctcgggtagctggctcttcctcaccctccaggcctccaggcctcagttcaaatgcctctccctgggagaggctggtcctgaccaccaccgcctcctgcctaaacacagcagattctctctcccctctagaatccaaacaccaggggagcaagagtagagttggtttcattcaccccgggctctccaagcatagcaaacgctctggaagcacgtgatgagtggctgggtgacgaagagctacgacccgagacatggtacccacatgggtacccaccctatgggtagacacgagcctggtgtcaggaggaactgggtttgaatccttcaacaactgtgtggcctttcctctctctgagcgtcgatgtccttattcgtagagtggatgatcataccttccttgcagagccattgcacagatagtgacataggcacacacaatacagtcctggctcacgctcaggagacagtggctgtcaagtcaggagcccgtcctgcagcagcctagccatctggaaggatcactcctcgacatgccgtcaatgcctggcacttggtaagaatgagtttctcacatttctctgaagggatggggtggggggcaggtagagaagaaggctctgggcacctagggtgggaaggaagaagagagagactggccctgagggtagccagtgcctctttgttcattttctcaccagaataacaggggaaatataccatttagaaagaggcagtgaggattaaatgagctagcatatccagcacatagaaggccctctccccatcctcgtccctgaaagcaaactcctcgatttctcagttttgctctggttcccaggctgtgcatggaggcaaacacagggcccttcactcaggccaagctcaggagagcccaggctgcaccgagtccacactctcggctcatttccctcagtccaccaagaggatgacaccaaggccccctcctgtacccctgcctctgccccagcaagtcctactgagatcctgcctgttatgaaatggggctgtcccattgggtgcagggcagatggcaccatgcctctaggagcctcagcatgtgtttccaaggagacagccgtgtgtgtgtgtgtacacaccaacttgtaccatccagttcttcaaaggaaggtggaaagaagggaatgagggtcaggttgcaaatgggatgtaggtggaagacgcacgacgccaggccatgctgctgtttgcctttcacagaaaaaaccagcacagcatctcacggtttgcagacactttcacatgggataactcacttaatcttggcaacaagctcatggcacagatattcttttccgctttttaaagtctggagatggagagagaggggggcaagtcccaaccagtgggttgtagaattaggatttgtggcctgactctgatcataagccccctgctctcttcccagggccacactgccttgcctagaaaggattctagatcaggagtgcccctacgtggggatgccgcctgcccagcccaaagcaaaggccttgttcagcctttgaggtgtatgttccggcttcacaactccctgaaacggaggcctgagtgaccggagatggcaagaaaatgggaggaggtgtctctaagcatggccagggccccatgggagagggaagtatagggtataaaatgctaatcatatgatttagagacacagtgtctttccagaagctggaagagaaagacgttaagagctggagtgagcagtctggaacagaatcaactcttggaaaagtatccttgggagacaggttgggagtgaagacaggaagagtggttttcaggatttagggcccagggacatagaggggaaactgagtcagggcttggctacagacccacccttttgctggaaatggatttctctgccaaaagagaaattgtttgaactcatggcctagagtgaaggccaccaagaagccattgtcgttggaagccaagggagtctgggagctggtcagctctggtggagaaagtctgtttatccagggacaggaaagaggcaaggtctacacgggctgggctgggaggcccaggggcagcacgagggagagggaccccaagtctgggtttcaaggggcatcaatgaactagaaaacggaatgaggctgggtgcagtggctcacgcctgtaatcccagcactttgggaggctgaggcagctggatcactggaggtcaggagtttgagaccagcctggccaacatggtgaaacctgtctctactaaaaatacaaaaattagccgggcgtggtggcgggtgcctgtaatcctagctactcaggagactgaggcaggagaattgcttgaacacgggaggtggaggttacagtgagctgacgttgcaccactgcactccagcctgggcaacagagtgagacactggctcaaaaaaaaaaaaaaaaaatgccaggcgcagtggtttacacctgtaatcccagcacttcgggaggctgaggcgggcggatcatgaggtcaagagataaagaccatcttggccaacatggtgaaaccccatctgtactaaaaatacaaaaattagcctggcgtggtggcgggcgcctgtagtcccagctactcgggtagctgaggcaggagaattgcttgaacccaggaggcagaggttgcagtgagccgagatagcaccactgcactccagcctggcgatagagcaagactcttatctcaaaaaaaaaaaagggggaaagagaaaataaaagaaagtggagtgagaggctgcacggagcggagagcatggggagagcacacctggagtttctcacactccgcagactttcctgtacacttccctcccactggaggtgagatacgctctgcacatgacctaaatgtgtgccgaagcacagccattgggcaggagaaagaagagaaaatggggagtttgtaaacagtcatccaaagagataactgcccccttccactggacgggagcagcaggaagtccaccaaagcaagggcacgcggacctgagggcatccctgttttctggagcacctggcctctgttgtctttctccaattcacacccagagtcagagcagtggcagatggaagagaagccacttcaacaactacttaagtacatggtccctgatggcaagtaattctgtaatcattctgtgtggtggctataccctcttttcaacaaggtctattgcttttcaggtagacgtttctgtttataaatggtctggagattcgggcagctttgggaaactgattgcagattagggggcagtaatgtgctgcagtcattgtgagtcctgtggctcttcagccctcttcccctcattttatctagcagttggctgctggcatctgtcggtcctgtgggacctcatgcttctcactctcagtgagatgccacatgaagtgacaggaggtgacccaagactggcccacaccccttggacctgcccagccatgctggactaactaattctcggccacagcttgccagtgctcggcaaagctctgcctgaaaccttgggcggtcccctatgtgccaggccctgactttgctcatccacagtgagggagggggacttttcggctattgcagggccccacagaccagctgggagccagagaccggcagctgctgccacacttcaaaggccttgttatcctcatctgaggagcagtgccccgagtcgcccctgagaatcctccctgccccactggcagcctcgcccttcatgtgtgtgctggggggcatcctgggacaccttgggggagccaggagggactgtaccacccttcctgggttcctggaccaaggaggggaccctctaccttagcttttggaaatgtgttcagctctgcccacccacacaggccactcagagatgccaaaaaagtcagctgtggcttgtttgtgggtgtggactccaaatgggggcagatccctccggctgagttgcagagggcttcgctgaggaggtgggcttctcatggtgagcaactggtgtccccagtgctaggaggccacaggagcgccttctgtgacactcttctcagagggtggcctggactgtcccaccatttgacagcatggagtgtggtcggaggggcctgagcccagagctgcgtgcgagagctccggagcccctgccctaagctcccagtacgtccttccccgttcgggcaatgtctccctggggctagaacctgctgaccctcctttcctggcttagcccaagcaaacccacacccagttccagaggggtgaagggaggccgggggctgtgggatctgtctcctggctctggtttgggagtgggctgagagcgtcctgtggaaggaaggagtcctgcggggacaaccagggccacctggtgatgctaggtagcaggtgctggcacagcaggatgagagggaggcctgagaaaggtcccctgagaggacaccccaggtgctcaagtcagactcaggcagcaaaagccagctgggcccctctaaaggcaaggaggagttggagccctggggacctgggggtgacctctgacttctgggaacagaagagatttggagagagatttatcagtattctccgccaaactaatctggccatggggttcccaggcaggacttgggagacacctggtgctggccaccaggtctgcccctcagtccacgccctcctctctcctccctcgcgcgttttgcctgtggtatcctaggaacgcagggcttcgagccttgtggtcctgttacataacagtttccatcccatccatgagttcagccctccggcaagcgggagctgcagcaggcgcaccaaggaaagcctctgcttcagacccaggctcctgctgcccaaatccacagtccctgccgctcctctgccacccccagcgtacagggggagggagcttcaaaagcagtcagcatccagccagattctttcaataggaccccctgtcctgtcctggtcccacatgagcacagcacctgtcagtggccacacactggccatggcttccccaaatccagcaggcctaggagagagtcccagagccggtgtgacacatgcctcctcgaacccctctccgcactctgcaccctgagaccaagggcgcaccactgctgagaccctccctggcttggagatgcctgtcctgccactgtgcctgtggctgccccctcgccccctcgagtacctgggcagccaatcaatgcaggtcacctgtgctcctacctgttctcttctctggccaaggcagagagtgctccagcagggacttgaggacctcaggcatgtccatggcaggggccactgagaaccagtcgcagctcacacagcccagcaggaggtgcttgctccagggagttcagaggcagctggagaggcaggggccgccagccgcaggctagggaggcaggcggggtgggagccttgaggcagccaatggccagcaccagtcccagcccgcccgtccacccccggctcggccacctgccagctccggctgcagccaggccttcccttcccgctgcttggcagggcgggcctggccctgcgccagctgcagcacgtggagctgtcgcgccaatcctctgacagagagcccagcctgttatctaactttggaaagggaagttctcccccaggctgggagccataactggggctgccaggtgagaatggtaagctccacgcccacagcaagcacgcatcagcatggaggtgccctggaggcccaggcacgcagtggaaaccatcccgggctgggacctgaggctccaagagaaaaggaggatgacaggcaaggacagcacctcaggcagccgagcacaagacaccctgtgttggcagatgcagggatgcggtcggacatcatgccttcacctgtgcgcttctgagcctcaagggcttgtggcatgttttgatgctgtgtttatgccatgcacacgtaccctacaaggcacgccagtgtacatatggcatgcataattggagctttataccatctgcacagcctgaagcctgttccccaaaaggaagtgataaaacctaccgcctcaggttctttggtcttcaggggagaggggaaaaggggcaggtgcaggagaccaggcaccactgaaaggggggcagctctgcagcctgcttcaggcttgtcctggatgaggaatccctgcttcccagtcattgtggggacttaaagtgccaattggctatttgctgtagttccctctcataccctcccaccaggacgctggcccctgtggtccttgggttacttgaatgggtgaagcaaaggttctggatgtcaacctctacgtcagaccaacatcacgtcaaagccagacttgccgggggatgccaggttctcgattctgccgtacattgctgtgggatcttgagcaagcgtggcagcaactctgggtctcagttcccgaaccaccgaatgcagtgacctctaaggtgccgttcagctctagttctatggctctgaagctccagatgggctgcaataaacatttggttttctgcgtggt

SEQ ID NO: 466772 - DNA, 2276 bp, Homo sapiens
  misc_feature (1)..(4): n is a, c, g, or t
  misc_feature (8)..(8): n is a, c, g, or t
nnnnggtnagtccagaactcactaggaggctcccagacgctgtgtccgtgtttctcctccagaccgacgatgctgcctgtgtcactgcctcagggccatgtcactgctgctgccccactggactcccacggggcctgtgggcctgagctaattttcctggctggccccagtccaggcagctcaggtggagagcgccaagctaatgaggccaaggtcatggtccagttagcatctctcggaggaaccgtggcttttcagccagactgtagctccctgaccagtcactgcgctcaggtagaggcgggccctagaggagaggacaatagcaaagctggatcctgcaagtcagcatttccacaacagcacggaatgaacactattgatgcacacagtaacctgaatgactctccagagaattatgccaactgcgaaaaggcaatccgcaagagttacacaaatgtggccaacagccccagtgactaccaccacagtgcttttgaaaaccactgcccagagccagaaggatggaggatcagcatggcggtaggaggaagggagaagccagaggggaatgaggaggagccggggtgcctgcagcggctccgaccgcctgtcctccaaggtcccgggctgcggctgcgcagcgccgacagcacgatgcgtgtgccgacagcgccacctcctggctctgccgaggctgttggcaacacgcagggctcgcagacagtggacatctgtttgccaatgcagacctcgtgctcactggaggctggagaaggcacgctcaagaaacgttcaaggcatgacagctacccagaaggcctctagtgccccaagagctgctcatcagccccattttcttcctaatattatttaaaaatttaaagaaattcagtgaaagtgtaagcatacaggcataggtagtaggtaaactagaattcactcttgctgggggaataccacccagggtttgaaaagatacagaaggcaaaagaaactgcatttagtataataaaatacaattaggcagagcacggtggctcatgcctgtaattccagcactttgggaggccgaggaaggcggattacctgagctctggagtttgagaccagcctgggcaacatggtgaaaccccgtctctacaaacatacaacaattagtgagtcttggtggtacatgccagtcatcccagttatttgctgggctgggctgggatgggaggactgtttgggctcaggaggtcaaggctgcaatgagctgtgttcacgccactgcactccagcctgggtgacaaagcaagaccatgtctagaaaaaataaaaaaattagcagcctataattccaaagcagaaaaccagctggctggctatgcactaaatctgaccagccattgtgtgtaaggcgtgtgtgtgcaaatgtgtgtttgcatgtatatcgtttaaatagttactttatttaccaacatttacatttaaggaaatttcacatcaaataatctataattctagaatcttcttaaacatgaggtgggcaacatgagacccccacttctatcagtatccatcctgactggacccaagtggacagcttgagtttccagttcaatccagttcctgcctggcctctgctggcctctgggtttgcaatcccaactccctaccaccgccactactgctgagagcatcccctctacagtactcagaacctcactggctgcctgcaaccctgggggatcagcagaagagactctaagcccatctatcagtgcccagagaaatgcacgtggcccacggctgctgccttctgaggtcacctggccataccccaagtagtctgggaacccatgctgagcctggagaatcttcactctcccacctctccctccattcctcaggggaacaaggactccaaaagagccgtcggataaacctgggtttggatccaggctttctaccttggacaagttacctaaacctcctgcatctcggtttcttcttcgtcaaatggggacaatacttctttctttaaaggctttactttgaggatgaggtgagagggaagccatcctcctccgtaccccacaaggatcacaggccagtgagatccagctattatcacctctggtgatgctggtcgccaacaacccaaggacccctgttactgagctctaaccagaccctccctctagtatccaacacatactctcaagggaaacagaaatcacacagaagaggccaggcaggcgcagtggctcacgcctgtaatcttagcattt

SEQ ID NO: 466773 - DNA, 945 bp, Homo sapiens
ggccagtgactttctgttcacgcacttgagagaatcaccatgtctaagggctgccagatagttacctgtgcgtgtgtcaaggttcacatcccattactactgaggccttggatagaacatgttcccacttttagttgtgacgagatgactggccccagcattgagaacaccaccttcccttcagcaaagggtttgtttaaatttacagaagtggtgaagtgcttattaccctccttgcactggttcctagggagctcagagcctatcttttccaagtgtcccgagcctcctgtaggcctttcgtgtgagtctccttcctggcttcctcccattcctcttaagtgtctgaacctgctgtcaggcacgtctatggcaccactctggaatctcatgattgactttgacctccccagccccactgaccatccgtggataactggacattaggtgatggtggaactacccctcaaaaacaatccagacttcattcccacaaggctaaaagaattttgttcatcttgcaggttggaccaatttagggtagaaaatgtataaacagaagcaaaacacaaaacccagggtttctggtggactgaggatatttattgagggtttattgagtgtaggaagaagggctggatgacttgggatggggagagagaccccctcccctgggaacctgcagctccaggcccctgtgggtggggtgagggtcgggggcctaagagcattctgcaggggccactgtcttctccacggtgctcccttcatgcgtgacctggcaactgtagcttctgtgggacttccactgctcaggcgtcaggctcaggtagctagctgctggccgcgtacttgttgttgctctgtttggagggtgtggtggtctccactcccgcgttgacggggctgccatctgccttccaggccactttcacagctcccggg

SEQ ID NO: 466774 - DNA, 1978 bp, Homo sapiens
  misc_feature (3)..(4): n is a, c, g, or t
  misc_feature (6)..(6): n is a, c, g, or t
  misc_feature (15)..(16): n is a, c, g, or t
  misc_feature (18)..(18): n is a, c, g, or t
tgnncngggtttttnntnaggttcctgggtaaagggcgctgtgcctgaagaacttcacaaacactaaggacagaccctcttcctgcaatgccagtactcacccaagagagggtcctatcagcccaaatcctggtgtcagcagacatcgccaagtcggtgtaccttacttgtcaccagctccaagccccagacagcagttcagaagtctcattacacaatctgggacaagccaaatgctagcatcttcaaaatcaccatgattcagctgaaggaggactcgggatcctactggtgtgaaatctacaacacttccaaaaacatcatcactgttctcagagatgtcagcctggtggtgtttgcaggaaatcaagtgcccccatctgccttggctcagctggccccaaactcctggtctctgtgttgtgtggactcctcctggccaagggcctgatgctgtgagtcctgtttgtgttcctgacctgcaggtgccacaggacagcagtgatggaggtttctgattgtatcagcccagccttgccccaggacccttgggtgcatgagtcacagcatggatccaggatgaatccccagttcttcccctgcccagctattgggagctgccctaagcgttgccccccatttgtctgtgaggaaaggccagcactaagcctattggagagaactttcagcccctgatctccctggtggtgacccctcacccctgcactgacccctcttagatctacttcccctgccctgactttcgccattggaaagacctggggtgggggtttctgcatccgggtcaacgctcagctcagcatcttcagctgtgcccgggctcctctcccagcactccgtggttctctcagccccacctcagcaggtctccaggatgcctcacattttccctgtttgttagtggtctacccgagagtcctatcaatttcctcttgtgcttgattaaattcaacctctgaactgaaatgtgtcagaggcaactaagcaagaaagcagatgtatcccctcaccctcctcccctcccaccctaaatgagaaagaaatgacttaaaaataaataataaaattgaaactaagaaaggctgtaatcagcagactggaaactgaggaagtcctagaagtaaaagaaaaaatcagatgccttaaatgacaagagcagtggattcagcagcctaaaacaggacccagaacattcaatggaatctcatcatcaggggtcaaaattctgtttgtttaacgtgtgaggagattcatagcctaaaagagaaaatcaagttgaactaacaatatttgatggtgggtgaaagataaatgttttggggaacagaagaggagcacacatctgtgaagcaagaaaaggcacagtcattttccaaccaggcaaccactctaatgcatgtgatatgtaaccttaaatttgaatatattcttgtaaagcctgcagcttttttttctgtgactgtattttaacttacatataagaaattgtgatagacatttttcatatattcgttttgctccttcccgggtacatatacagagcccacttcttttcagtgcttattccattgtgtacatatcccacagtgtatcattctgaacccagggtgcatgtgctgttttgcctccacttcttcatattgcaaacaatgctgtgaggaatattgtccatcatgttctctggtagaatcaggtgagatttcctttaggacttatacccaggtggcatcagctgagttttacgatctcagatgtctaagtaatgctgtcagcttgtgttgcccgaaacacgaatctagacactagagattattttctgtgagtctatgtgaagtacacagcacaacctatggaatagtattgccaataaaaaaaaatggaaggcaagagtaaatgtagctgagtgatgctacatgggggctagaagtatgattatctttttaaaaaaatttttttc

SEQ ID NO: 466775 - DNA, 3692 bp, Homo sapiens
  misc_feature (3)..(4): n is a, c, g, or t
  misc_feature (6)..(6): n is a, c, g, or t
  misc_feature (15)..(16): n is a, c, g, or t
  misc_feature (18)..(18): n is a, c, g, or t
tgnncngggtttttnntnaggttcctgggtaaagggcgctgtgcctgaagaacttcacaaacactaaggacagaccctcttcctgcaatgccagtactcacccaagagagggtcctatcagcccaaatcctggtgtcagcagacatcgccaactccaagccccagacagcagttcagaagtctcattacacaatctgggacaagccaaatgctagcatcttcaaaatcaccatgattcagctgaaggaggactcgggatcctactggtgtgaaatctacaacacttccaaaaacatcatcactgttctcagagatgtcagcctggtggtgtttgcagccccaaccacgtctcctacgtggaccctcacctggctcccaacaaacacaggccatgactcaaagtttgttagagaggaaaggggaagaggatgcaggttgttaattgtggaggaaccatggaaaagacagttcaacatggatttctgcaatgaaacaaaatggaacccagaaaatgtggaaaccttagaccgtgttggtgtgttgaaggaggatttagcctctgttcttccccattaccagattcatatctaatatgcctaggcgaatctgaattcacaagccaaaatacctaggcttcttggtagaagcactgccttagaagaatgacaacacagccaacaatagaaacttgtgaagcagaactatgggaacttcccattccccaggaactgaatcagtatgtcagtatattcagctctcttattctttgattctccattttaaagtttaacttcctggttctctttggccccttgcttctagtttcagtaaacaactttcctgccagtcctaatcaatagttcacatctgttccgctggtcacctgctccatcctgactcatcctggtcacttgctttgacttgagtcacctctggtcacctgctccatcctgactcatcctgttcacctgctctgacctaagtcacctttagttacctgttcctaaccgtccttcctgctaaactactcaccccaccactctggctcatacccctgccctctccatagccaatcggtattagcttaggctgtgcggtccaaccctagccactaggggaatgacacagcagtaggggctaccaccatcaggaataagaactgctgcccctcccctgtccagatgtgctctcgctgttgtttcatctgtgaggagtaccctttctgcagccgttgtttcatctgtgagaagcaccctttctgcagaaagtaaaaattgcctggctgagaaaattaaatttatgttcgaagcttttcttgcagcactggggaacaagcattttgcatttctaacatggatcataaggaagatccatcgaaaaaaagagccaaatcgcaatcatagttgtgaaaaatattatagacccataatgtatgtgatgaaggatggctgtggctggacagtgagcaggaagaggagtgaggaattctcatggaaggtcctggaaagaactggagatttaaaaatcaaagacaagttaggagacatgaaggagaaaactagatgtactaatatatcggtatcaagaacccctgtgggagataaaggatgaaagaaagaaacatttgaagaaagaatctaaggaaacttttcaaaactatagaagaagaaaagacctcacattgaaaagattcataaattgccaaagaggggaaaacagcacacacacaaaaaacaccagtagacccattaagtaaaagggaagcacatcaaaaacagagggaaaagtctgaaggctttcagatcacctacaaggcaacaagattagaattccctctgagttcttaagaggaacactagaggtaagaagacaattgagtaatatttctaaagtactaaagaaaaactttgtatatagtgttttgtattcagccaaattgtcactccaatgtgaaatcataaaacctctggattctcaaggcctcagaaggtttgccacatgcaaacatccccactgaaaacactcccagagaaaggaagccaggatgaaaaataaaccctggggatgctgcaagaggaaatcaagtgcccccatctgccttggctcagctggccccaaactcctggtctctgtgttgtgtggactcctcctggccaagggcctgatgctgtgagtcctgtttgtgttcctgacctgcaggtgccacaggacagcagtgatggaggtttctgattgtatcagcccagccttgccccaggacccttgggtgcatgagtcacagcatggatccaggatgaatccccagttcttcccctgcccagctattgggagctgccctaagcgttgccccccatttgtctgtgaggaaaggccagcactaagcctattggagagaactttcagcccctgatctccctggtggtgacccctcacccctgcactgacccctcttagatctacttcccctgccctgactttcgccattggaaagacctggggtgggggtttctgcatccgggtcaacgctcagctcagcatcttcagctgtgcccgggctcctctcccagcactccgtggttctctcagccccacctcagcaggtctccaggatgcctcacattttccctgtttgttagtggtctacccgagagtcctatcaatttcctcttgtgcttgattaaattcaacctctgaactgaaatgtgtcagaggcaactaagcaagaaagcagatgtatcccctcaccctcctcccctcccaccctaaatgagaaagaaatgacttaaaaataaataataaaattgaaactaagaaaggctgtaatcagcagactggaaactgaggaagtcctagaagtaaaagaaaaaatcagatgccttaaatgacaagagcagtggattcagcagcctaaaacaggacccagaacattcaatggaatctcatcatcaggggtcaaaattctgtttgtttaacgtgtgaggagattcatagcctaaaagagaaaatcaagttgaactaacaatatttgatggtgggtgaaagataaatgttttggggaacagaagaggagcacacatctgtgaagcaagaaaaggcacagtcattttccaaccaggcaaccactctaatgcatgtgatatgtaaccttaaatttgaatatattcttgtaaagcctgcagcttttttttctgtgactgtattttaacttacatataagaaattgtgatagacatttttcatatattcgttttgctccttcccgggtacatatacagagcccacttcttttcagtgcttattccattgtgtacatatcccacagtgtatcattctgaacccagggtgcatgtgctgttttgcctccacttcttcatattgcaaacaatgctgtgaggaatattgtccatcatgttctctggtagaatcaggtgagatttcctttaggacttatacccaggtggcatcagctgagttttacgatctcagatgtctaagtaatgctgtcagcttgtgttgcccgaaacacgaatctagacactagagattattttctgtgagtctatgtgaagtacacagcacaacctatggaatagtattgccaataaaaaaaaatggaaggcaagagtaaatgtagctgagtgatgctacatgggggctagaagtatgattatctttttaaaaaaatttttttc

SEQ ID NO: 466776 - DNA, 1016 bp, Homo sapiens
ggccaggctgcctgctcaaggacactggggttggccagcctttcagacaagggtgctgccgcaacccagtctaggagcggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaaggcaagacattaagactgagtaatgtgtactgatgaggcaggagacagtcttcagatctggacttcagactgtcttcagttaacctgtgggactccttctccaagagattcattcaatttttatttgttcaacaacaacaaaaatttggtggtggcctgaaagctccatacattgaaagtaattgggggacaaaaaaaaggatgcagagaaccagagctttcctttttcttggccataccgaatggccttcataggaacttaggggccaccctcgtacatctgtgcaattcagggtctcttcatgatttgtcaagattctgaatcaagtggtttgatcagatttgcaaattatgagggcaggtaggtgggcgatttctttttctttttttttttttttgagatggagtctcactctgtcatccaggctg

SEQ ID NO: 466777 - DNA, 1510 bp, Homo sapiens
ttgagaagaaaagtagttcagcaaatggagaagactgggagaaagaattggaagccttccaaatggcacagcaagggtgtttgcaccagaagaagggacaagcagttctgtatgaaggtggaaaaggctatggaaaaagccagctgttggctgaaataaactttctggcacagaaagaagggcatagctacccttcacaggtgctttggaaacccactttattgtgaggtcctatgccaggaccttctctctaaggacgtgttgctctttcatgtcctacaaaaggaggaagaggaaaacagcaagtgggaaaccctctcagccaatgccatgaaatccataatgtatagtatttctcctgccaactctgaggaaggccaggaactttatgtctgcacagtcaaggatgatgtgaacttggatacagtacttctcctaccctttttgaaagaaatagcagtaagccaactggatcaactgagcccagaggaacagttgctggtcaagtgtgctgcaatcattggtcactccttccatatagatttgctgcagcacctcctgcctggctgggataaaaataagctacttcaggtcttgagagctcttgtggatatacatgtgctctgctggtctgacaagagccaagagcttcctgctgagcccatattaatgccttcctctatcgacatcattgatggaaccaaagagaagaagacaaagttagatggtgggtcagcctctcttctcaggctacaagaagaattatccctaccacaaactgaggtgttggaatttggagtgcctctgctacgggcagctgcttgggagctctggcccaaggaacaacagatagctctgcaccttgaatgtgcctgctttctccaagttttggcctgccgctgtgggagctgccatggaggagactttgtcccctttcatcattttgcagtttgttctactaagaattccaaggggacctctcgattctgtacttacagagatactggctcagtgctaacacaagtgatcacagaaaaattgcagctgccttctccccaagaacagaggaagagttcctagatcaagtgaagaggaagctggctcagaccagccctgagaaagacctgttgaccacaaagccttgtcactgtaaggatatcctgaagttagtgctcttacccctcacccagcattgcttggtcgttggagaaaccacctgtgcattttattacctgctggaggctgcggctgcctgcttggacctgtcagataattatatggtctgtttcaacatgggacgtatcactttagccaaaaaattggctaggaaagcccttcgactgctgaaaaggaatttcccttggacctggtttggtgtccttttccagacattcctggataagaagaatttggcagtcctgcagcagcaggtgcattgcctctccctactctggcagctctataacctggaggccacagccagtagctacaggtttgcctgcctggctac

SEQ ID NO: 466778 - DNA, 1634 bp, Homo sapiens
gaaagaagccaaacacaaaaggttacctattgtatgactccgtttacatgaaatgcccagaacgggcaaatgcattgaaacagaaagccaatcagaggatgaagggagggcagaacggggagtggctgcttaatgaatgcaagccaggccatggcccacctaaattctggaaggccccacctcccttagccccaacaggcagtgctcatcatcaacgactttcctccaagcccccgccctctgcatactgcatggactccaggagtcccctgcccccactcccacccaggaaagctggtctaggaccaatcagaggctgtggaactttctggaaggcccagggcttctccctgggtggggcagggcctctgattggaggaggcctgccagaagggtggggcgatgggcgtggctaacgggataactgccagagcagaagacagttggcagttatttcgcaaccttcatctgttcctggaagatacccgtagcctgccttccttcttgacaggctgatttaggggtgctccccaagaagatcaggactgctgaaagaatgaagaagaacttacttggcctaggatgtggctagagaacggagcgcactttcacttacctggcaaggtggttttggaagtttccacggaagccttcccagggccgctgctgcccgtcctcgcctagaagaattccattctcccatcccaggaaggagagtgccctgcgtgccacgaaagagcccaggacccacaggacaaatacgtcactggcagacctgccttcgccagcgccagcccatctctgaaacctccagcatttgtgccccggtccggcccctcccaggcctgactctttccgtgaacggtcactgcgcaggatcaagctacaatgaagaggagggaggcagtctgcgcgcaccgccattttctaggaactgggaagcccccccaccccttaggaagatccatccctgtggaaccttgcccaggcttaccagcctttgctgaggttgatctattgtccctccttgtccccatcaaaatatccagcactccaccttcagggagtagacttgaccctcaaatagcaagttcagccttcccaggtctaggttccctgggaggtcaagattcgtctggttccttagtacagagggctagctgtgagttggaatccccctatgagctttagaatcagtcaagaggaattgggccccttcccttcatccctcttcttttccctttttgtcccagagctcagctctgactcaaaagtttttccatttaccatcaacatggaaacttggctcctcacgtaggtatattatcccccttttgtacatggtcttgttgatccaaactccctttctgtgaaagaggcctgtggggctcaagaagcctggtcagccagccaggctagtcccacatacctcagaaccagtttaataaaggctctatgtcattcaaaaaaaaaaataaaggccttctggcctcaacagtgacctttagcgcgcttccttaatgggagaattcagatcccgctcctgactactgccgtgggtgttacgtgcgcgagcggtttagctatctaaggaggaatcggtttcacgatcaaggaaacgagaaaacatgggg

SEQ ID NO: 466779 - DNA, 912 bp, Homo sapiens
ctgccagcaaagccctcttcaacccactggagtcagcaggcccagtgcttcataaaccaagttatgagagcagagctgagaatttctaaggagcctcctttttaaagcctttcacttcacctgctctccaacagctggaacggtcactgcgcaggatcaagctacaatgaagaggagggaggcagtctgcgcgcaccgccattttctaggaactgggaagcccccccaccccttaggaagatccatccctgtggaaccttgcccaggcttaccagcctttgctgaggttgatctattgtccctccttgtccccatcaaaatatccagcactccaccttcagggagtagacttgaccctcaaatagcaagttcagccttcccaggtctaggttccctgggaggtcaagattcgtctggttccttagtacagagggctagctgtgagttggaatccccctatgagctttagaatcagtcaagaggaattgggccccttcccttcatccctcttcttttccctttttgtcccagagctcagctctgactcaaaagtttttccatttaccatcaacatggaaacttggctcctcacgtaggtatattatcccccttttgtacatggtcttgttgatccaaactccctttctgtgaaagaggcctgtggggctcaagaagcctggtcagccagccaggctagtcccacatacctcagaaccagtttaataaaggctctatgtcattcaaaaaaaaaaataaaggccttctggcctcaacagtgacctttagcgcgcttccttaatgggagaattcagatcccgctcctgactactgccgtgggtgttacgtgcgcgagcggtttagctatctaaggaggaatcggtttcacgatcaaggaaacgagaaaacatgggg

SEQ ID NO: 466780 - DNA, 1784 bp, Homo sapiens
gaaagaagccaaacacaaaaggttacctattgtatgactccgtttacatgaaatgcccagaacgggcaaatgcattgaaacagaaagccaatcagaggatgaagggagggcagaacggggagtggctgcttaatgaatgcaagccaggccatggcccacctaaattctggaaggccccacctcccttagccccaacaggcagtgctcatcatcaacgactttcctccaagcccccgccctctgcatactgcatggactccaggagtcccctgcccccactcccacccaggaaagctggtctaggaccaatcagaggctgtggaactttctggaaggcccagggcttctccctgggtggggcagggcctctgattggaggaggcctgccagaagggtggggcgatgggcgtggctaacgggataactgccagagcagaagacagttggcagttatttcgcaaccttcatctgttcctggaagatacccgtagcctgccttccttcttgacaggctgatttaggggtgctccccaagaagatcaggactgctgaaagaatgaagaagaacttacttggcctaggatgtggctagagaacggagcgcactttcacttacctggcaaggtggttttggaagtttccacggaagccttcccagggccgctgctgcccgtcctcgcctaggtgtggagcttcccgaccggctggggagggaatgtcctgcgggagccgccgaggaccctctttagcctcttccctggcttggctgcagctgcagtctggtactcgcccattctgctcttcttcacctccgtattttctctctcacggaagaagaattccattctcccatcccaggaaggagagtgccctgcgtgccacgaaagagcccaggacccacaggacaaatacgtcactggcagacctgccttcgccagcgccagcccatctctgaaacctccagcatttgtgccccggtccggcccctcccaggcctgactctttccgtgaacggtcactgcgcaggatcaagctacaatgaagaggagggaggcagtctgcgcgcaccgccattttctaggaactgggaagcccccccaccccttaggaagatccatccctgtggaaccttgcccaggcttaccagcctttgctgaggttgatctattgtccctccttgtccccatcaaaatatccagcactccaccttcagggagtagacttgaccctcaaatagcaagttcagccttcccaggtctaggttccctgggaggtcaagattcgtctggttccttagtacagagggctagctgtgagttggaatccccctatgagctttagaatcagtcaagaggaattgggccccttcccttcatccctcttcttttccctttttgtcccagagctcagctctgactcaaaagtttttccatttaccatcaacatggaaacttggctcctcacgtaggtatattatcccccttttgtacatggtcttgttgatccaaactccctttctgtgaaagaggcctgtggggctcaagaagcctggtcagccagccaggctagtcccacatacctcagaaccagtttaataaaggctctatgtcattcaaaaaaaaaaataaaggccttctggcctcaacagtgacctttagcgcgcttccttaatgggagaattcagatcccgctcctgactactgccgtgggtgttacgtgcgcgagcggtttagctatctaaggaggaatcggtttcacgatcaaggaaacgagaaaacatgggg

SEQ ID NO: 466781 - DNA, 1088 bp, Homo sapiens
aattccattccctgcaattggagcctgaataatgagttatttcacaggaagattgatctgggtattagggcatcatttagtttgccattacaacagccaattttggttacatgctcagctgtgaaggggaaatgggccagcctgctggagctttctaaagcatggagctgagaacggtgcagtcttcagggatctggtgagcagacggctacaggatttgtaccccaggattaaagccagaaaccaaaagaccatctgccggtacccacaggagggaggatgcaggtcattttcatgtgcagtgacatcgtaggaacggtcactgcgcaggatcaagctacaatgaagaggagggaggcagtctgcgcgcaccgccattttctaggaactgggaagcccccccaccccttaggaagatccatccctgtggaaccttgcccaggcttaccagcctttgctgaggttgatctattgtccctccttgtccccatcaaaatatccagcactccaccttcagggagtagacttgaccctcaaatagcaagttcagccttcccaggtctaggttccctgggaggtcaagattcgtctggttccttagtacagagggctagctgtgagttggaatccccctatgagctttagaatcagtcaagaggaattgggccccttcccttcatccctcttcttttccctttttgtcccagagctcagctctgactcaaaagtttttccatttaccatcaacatggaaacttggctcctcacgtaggtatattatcccccttttgtacatggtcttgttgatccaaactccctttctgtgaaagaggcctgtggggctcaagaagcctggtcagccagccaggctagtcccacatacctcagaaccagtttaataaaggctctatgtcattcaaaaaaaaaaataaaggccttctggcctcaacagtgacctttagcgcgcttccttaatgggagaattcagatcccgctcctgactactgccgtgggtgttacgtgcgcgagcggtttagctatctaaggaggaatcggtttcacgatcaaggaaacgagaaaacatgggg

SEQ ID NO: 466782 - DNA, 1948 bp, Homo sapiens
aagtggagatcgctgtggtcatgagtggcaagggacaggagcgcaactgcagaggcagggaggctgtgcggaggctgcggaggagcccggagcagatgggggctgggggaggggcatcgggcttagatgtcctccctctgctcgcagctcccaggtgcccacgtgctgcgctggctggaggcagcaaggggacgagtgtgggattggacgcgcagcagctctggcctgtctcgtccacagcggtgtgcgaaggcaactccacgtgctcagagaacgaggtgtgcgtgaggcctggcgagtgccgctgccgccacggctacttcggtgccaactgcgacaccagtgagcgtggggtcgggccggtattggtcggtggggcggaatcctggagagatggggcggggtccaaggtggggcggggtcggatccgccttcggggcgggtccccagaggtggcggctggagtgcgggacgcgggcaggttccggctggctgggggcacctactcaagcaccggggccttccaccccctccgctcctcccctgcagagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtaggtaaggatgacagcgcggggtatcttggagaaacacctctcgacgcaggaagctgctgggaaatgggtgtgagggggtccagatctcagtgaggaaatgggggaccttgagtgttgatgtgcgtgggcgcgaggaggtgcgaccagagggaaggtaagaggtgtggcagctgctgagggcgaggcaaggtacg

SEQ ID NO: 466783 - DNA, 3556 bp, Homo sapiens
tcccaggcatcttcctactgactgcaagtgtggaacaaggagttccaggaacccacaggcaggtcgttaatgagatttccagaaaatgctctccagatgtgtctgttgtttccagaacttccagcccagctggtctctgtggtctccctaatgcttctactgctgcagctgtcccaatgtcctttcccaacctgtcacccaagaccagtaccacagagcaatgagagcagcagtggacaaacggacaaggctactcaggaagaaatttgtaaaaagattggcagtcgaaattcagtcctcacttcccccttatctgaaatctacaagacagtggtcagtatgttccaactggtgggggtccaggtttctgaagaacaactcagggacacaggacagttcagaatctgcagtccaggccactcttgtggatttcatgagacagtgaacatctctggattgcctgttacgttatccaacatcctttgtaagagcatctctgcaataactccctcttggaatgacaaattgctctttttgaactctgaacagagactacccaccttgcagtagaaatttcatctctccagataagcttgtttgcctccttttatctgctaccacaaactatataacctaaccattggcatctttggaattgcatcctatacgtttaatgtaggaacagttcctgccttaaaagggcttccacagggcagagccataacgcatatgcagaacgcaggctaaggaagtcttcggggaggaaagagtatctcagaggggcaggtgcagccacagcgtgggcccgcgtgcctggtgctaagctgggcccattacgcgtacatcacatgatttaattctcactaaattgcaagctgggatggggcggggggacgtgagggttatttttttaatctctttttgtagttggaaaatcctggagcccagaaaggtgaagcaaactgcctgaggtcaagcccataatgtgaagtggagctgcaatgtctactcaagagtgtctgacatctgcactttttactctgccaggtaagaagaccctcaccagatgtggcccctcactcctggacttccaagcctccagaatcatgaactaaatacatttctatttgttataaattactcagcctcaggtattgctagagcagtagaaaacagactgagaaaggctgtgtctccctcctcagactgaaggatctttgtgatcagatgctgtgtctatatcctttgttcatttgtttgatatttgctgaggaccttttaagtgccaggcactattctagattcagaatactatgttgaaaagacagacaaaaccactggtctcatggaacttacaagttagttgcgacaaatgacaataaacaacaaacaattttaggttacaataagtactaagaagcaaataaaagcagcataatcgtcatggtaggagtggggtgttaactgaaatgtgtgactgaggcaagagtctcaatcaatcaaggtttattaagccagagcttgagaatatgtcttggaaaaacgcaagtcatagatgcatctgtggctgttttttccagaaatgttttttttttttttttcaggaggcttagtatttatatactttctgaaagggaggtttgctttgttattgcagacttggtccccagagctcagccactcacttcctgctctttagcacaatcttagtgaagccaaagagcaaaagacctccttaatcccaactctggatttacaacaggtgcctgcaaagcatgcagcctggcagacccagaagatgcagcccatcttcagcctgtcttccagacctggcagtcatcactggaagccccagtgtctcttctctgcccctacagctcagacaacctacaacaaacgtcagtgaagacctgtccttgtcacgtcccccgcaaatgggctgttaaaaggccaggttgggaagtcacaaggatccattgttgaaatctggcaagttatttaagttctcagttcctcagtttccccatctgtaaaacagagataatagtatatagttttcagggttgaaatcagatcataactacttggctccatatgttaaaaggggtaaaaatgattatgcttactatgtgctggacactgtgcttagtaatatttaattatcatagccatcatagctcaatgaggaaggtgcattagaatcctcatttctcaaatgaagaccctgaggtgcagagaggccacacaactcttcaagtatgccacctaccaggtagtggttctcagccaggtttggtactgtctccctaggggacatgttaaaacatgggtgtgtgcttttgggttgtcatgctggctggaaacactggggttggaagagggggcaggaaggattcctagtaagtgtgcccccttggcaatgtatggctcttatcatgtgttgaatagtcctactcaggaaaaattaatcagcctctgttttgagaaacactaattacagcacaatcccacattaacagaaaaggaactgagtcccaaataaagtgatgagtccagattcacttggtgcatcaggccagaagtaggacaagagccaagcccctatcttaaccaccaatctttaccacgtgggggcccaagccagattgtggaccacctgtaggggcaggccagttggcagcagtgggttggtgcttcctctcaaaaatccattgggaatggccctgtgatttccccttcccagcctgaggaaaacttgcccccctccaccctctatcccctggctagaaagatgttcttagttatctttgattggtttctcagatttccattgcccaaggccaatttccacaaagggaaggtgtcaataattacatttctgctctccataccctgtaattaataattgcgattaatctggcacacttagtcaaatattgcaggtcctaattggctgccgtgcctttcttcttctgattgagacaatcctattcttggcagttctgcagccagctgcggtgaactcagcaggacctgtcaaatgcttctgcttggcaatttgcatgacattttgggcggcaaagcagagtagaggggtgaggtagctgggccttatgcgttggggcagaggggctgagattaggaagcccctgggtcctggtcaaggtgttggaatagatctgtttcacccttaacttgccctgatcagacagagcacctcggggtttatttcagttccagatgcaaggtagccctgccctctcctttcacactggatgtgagagggtttaaggggaggtagtctggttccctcctcctcttgtcttcttgtcccagggggcaggaagtttacttcctatcgggtggtaaaaacaaaacaaaacaaaacacaccattgtaaccctggcctctgtcaattcatctctcaggccagaggtatgtactgcagcatccagtccctaggaggtctgggttggggaatatcagattgtaagggagggaaaacaatctttcctctatgcatttaggtttgctaactggaactctgcaaattaaa

SEQ ID NO: 466784 - DNA, 3468 bp, Homo sapiens
tcccaggcatcttcctactgactgcaagtgtggaacaaggagttccaggaacccacaggcaggtcgttaatgagatttccagaaaatgctctccagatgtgtctgttgtttccagaacttccagcccagctggtctctgtggtctccctaatgcttctactgctgcagctgtcccaatgtcctttcccaacctgtcacccaagaccagtaccacagagcaatgagagcagcagtggacaaacggacaaggctactcaggaagaaatttgtaaaaagattggcagtcgaaattcagtcctcacttcccccttatctgaaatctacaagacagtggtcagtatgttccaactggtgggggtccaggtttctgaagaacaactcagggacacaggacagttcagaatctgcagtccaggccactcttgtggatttcatgagacagtgaacatctctggattgcctgttacgttatccaacatcctttgtaagagcatctctgcaataactccctcttggaatgacaaattgctctttttgaactctgaacagagactacccaccttgcagtagaaatttcatctctccagataagcttgtttgcctccttttatctgctaccacaaactatataacctaaccattggcatctttggaattgcatcctatacgtttaatgtaggaacagttcctgccttaaaagggcttccacagggcagagccataacgcatatgcagaacgcaggctaaggaagtcttcggggaggaaagagtatctcagaggggcaggtgcagccacagcgtgggcccgcgtgcctggtgctaagctgggcccattacgcttggaaaatcctggagcccagaaaggtgaagcaaactgcctgaggtcaagcccataatgtgaagtggagctgcaatgtctactcaagagtgtctgacatctgcactttttactctgccaggtaagaagaccctcaccagatgtggcccctcactcctggacttccaagcctccagaatcatgaactaaatacatttctatttgttataaattactcagcctcaggtattgctagagcagtagaaaacagactgagaaaggctgtgtctccctcctcagactgaaggatctttgtgatcagatgctgtgtctatatcctttgttcatttgtttgatatttgctgaggaccttttaagtgccaggcactattctagattcagaatactatgttgaaaagacagacaaaaccactggtctcatggaacttacaagttagttgcgacaaatgacaataaacaacaaacaattttaggttacaataagtactaagaagcaaataaaagcagcataatcgtcatggtaggagtggggtgttaactgaaatgtgtgactgaggcaagagtctcaatcaatcaaggtttattaagccagagcttgagaatatgtcttggaaaaacgcaagtcatagatgcatctgtggctgttttttccagaaatgttttttttttttttttcaggaggcttagtatttatatactttctgaaagggaggtttgctttgttattgcagacttggtccccagagctcagccactcacttcctgctctttagcacaatcttagtgaagccaaagagcaaaagacctccttaatcccaactctggatttacaacaggtgcctgcaaagcatgcagcctggcagacccagaagatgcagcccatcttcagcctgtcttccagacctggcagtcatcactggaagccccagtgtctcttctctgcccctacagctcagacaacctacaacaaacgtcagtgaagacctgtccttgtcacgtcccccgcaaatgggctgttaaaaggccaggttgggaagtcacaaggatccattgttgaaatctggcaagttatttaagttctcagttcctcagtttccccatctgtaaaacagagataatagtatatagttttcagggttgaaatcagatcataactacttggctccatatgttaaaaggggtaaaaatgattatgcttactatgtgctggacactgtgcttagtaatatttaattatcatagccatcatagctcaatgaggaaggtgcattagaatcctcatttctcaaatgaagaccctgaggtgcagagaggccacacaactcttcaagtatgccacctaccaggtagtggttctcagccaggtttggtactgtctccctaggggacatgttaaaacatgggtgtgtgcttttgggttgtcatgctggctggaaacactggggttggaagagggggcaggaaggattcctagtaagtgtgcccccttggcaatgtatggctcttatcatgtgttgaatagtcctactcaggaaaaattaatcagcctctgttttgagaaacactaattacagcacaatcccacattaacagaaaaggaactgagtcccaaataaagtgatgagtccagattcacttggtgcatcaggccagaagtaggacaagagccaagcccctatcttaaccaccaatctttaccacgtgggggcccaagccagattgtggaccacctgtaggggcaggccagttggcagcagtgggttggtgcttcctctcaaaaatccattgggaatggccctgtgatttccccttcccagcctgaggaaaacttgcccccctccaccctctatcccctggctagaaagatgttcttagttatctttgattggtttctcagatttccattgcccaaggccaatttccacaaagggaaggtgtcaataattacatttctgctctccataccctgtaattaataattgcgattaatctggcacacttagtcaaatattgcaggtcctaattggctgccgtgcctttcttcttctgattgagacaatcctattcttggcagttctgcagccagctgcggtgaactcagcaggacctgtcaaatgcttctgcttggcaatttgcatgacattttgggcggcaaagcagagtagaggggtgaggtagctgggccttatgcgttggggcagaggggctgagattaggaagcccctgggtcctggtcaaggtgttggaatagatctgtttcacccttaacttgccctgatcagacagagcacctcggggtttatttcagttccagatgcaaggtagccctgccctctcctttcacactggatgtgagagggtttaaggggaggtagtctggttccctcctcctcttgtcttcttgtcccagggggcaggaagtttacttcctatcgggtggtaaaaacaaaacaaaacaaaacacaccattgtaaccctggcctctgtcaattcatctctcaggccagaggtatgtactgcagcatccagtccctaggaggtctgggttggggaatatcagattgtaagggagggaaaacaatctttcctctatgcatttaggtttgctaactggaactctgcaaattaaa

SEQ ID NO: 466785 - DNA, 2262 bp, Homo sapiens
ctaattataatgcagcacaataacgatgaggtatgttattacctgtactgtgttaactagatcaaacaaccaacaagagaagaactggccttctcaacaagagaagagtgtgtacctctgcagagcagctgatgatggcatgagccatctaaagcatgcgcagcactctgctgataaagcacccttcacacttagtctgccttcagaagagaggagcattagaagccctcctgcctcagtccaacaggccaagcaaaatgccactcaaggtcacccagagaaagaaactaaaatgtcattacttggaattatgtctcttcattaccaaaaagaagatccaacttatgttatttctggcccatttaataaatattttttgaaggaggtcttcttatcctcgagtcatttaagaattactcacttaactcaaactgagcaacgatgccacgaacacatcaagctggcagcaccatttgctagcacctggcagatgagagagaaagaaaacctggtgtggagacccccatccattaaaggcaagagagtgaaaagtgggagagaaagctcccaagttcaacagcagtgacctagggtcatgcagtgaggacttacaaagtccaagaagaaagcatttggagaagtgctacacatgctcaactgaacttcctgtcaaattgttctcactcgtttgggcacaagtctgcttaagccatctctcattaacatttactcttgcccgaagccctctacgcccccaacccctgctaatcttccacaagcaagctgatcacactgggatctccttttcccagacacgtttgattctcactttctcctgaacctagaaatgtgcttcccaccaaagcatgccaggcactaactcgtccctactgaaaggggctgttaaaagctcatcttctttccagatggtagtgaggtgtgaggtgatcctttctctttcttttttttttttttttacttttagctacccctcaattctggtgttcagtaacaatgtattccacttaaaagagagaaatcatattaattattctaagatataaacacttaattttattcatgctcttgaattactttcctttctaccgcatgtttgtgtagctgttatatgagtcctttctactgatgtagctgtcattccttcaactcagttcttgccaaacactgagctatgtctggagatacaaagataactactcttgttgaagagatgccagtttagtgggggagacagacatgtaaacagatctgtatctgagatagatggcctgggtaggaaaagaatatatatagcacaaataactcagtggacctgcaaaaacagagcttgaggccatgatataccacaaagacccaccaaggcacaagcactgtcaacatgaaggtaaggcttccatttttgcctctttcaatctgggtacatctattctacatactctgcctttcctcctgttacaggaaaagaaggaacctcaattctacctaaagtcaatcttctccttgagctagagatccagcccctctcccataatgagggttattaactggcctaatttcaatattgtatctcagggaatagggagattggaggacagggagagatgggggaacaaccagtcagtggagcagtcagaatacacacatttatctattaaattctgtcttctatgggtgtggtttgtgatgttccaaaacaattacaatagtaacatcaaaaatcatcgattacagatcactacaatagatataataataatgaaaagttttgaaatattgtgagaattaccaaaatgtgacataggcacacaagtaagcacatgctgctggaaaaatagggccaaaacacttgttgaacacggagttgccataaccttcagttggtaaaaacaaaacaaaataccacagtatctgcaaagtgtaacaaaaaggggtatgcttgtagcactattctcattttaacttgaaatggtcagatagttggtaaatgaccaagctgggactgaattcggtccatttaactctaaaatctgtgcttaacacttatgtttacaagagagaatggtaaaaacgaatgtctgacaggagaaaacttgcagcccttttgacatgtggcttatagaatttatttcaagtaaatcagcatgatctggaaagtcaaaggcagcagagaaccaaaactgaaaaagggcttacttctagtgcatagatttttcccagaaaaggcaccaggtaatctgactg

SEQ ID NO: 466786 - DNA, 2290 bp, Homo sapiens
gagtgggttcagtggctcacacctggaatcccagtactttgagaggcagaggaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcactggcctctccctcaccaccatcatcatcggctgcttcctcttttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaactcatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttggtagttccttttcccttgaaaaatgttgggagtgaagtcaagagacatgtttgtttgtttgttttggccatactcttccaaaccatgagcatagtaatgacagtcgctggcttttactgaacactcagtgccagtctctggtgaagaatctagacacaggtaggaaaataccgacaaaggatacgatttcagccccttattcctttcctcctttcccagtcctgttcccttacaccaactgctgccactagaatcaccacctcatctcccagctccatctcaccaagtggaaaacaagtctttctaacagtgcaggtgtccccgggaagagcaacactcttaagggctgtcacccacccctgacactttcagtccgtgaagatcccccagccttccgtcctacttttcttcatacagtttattactgtgttgcagacctaggccccaatgtctgctgtttccttcttcgtgtccatatgtactcagtgttcagctcccactcataagggagaacatgcagtatttcttttttctgttcctgtgttagttcgcttaggaaacaagggttttatgcatgtgtgtttggtgtatgattgtgtgtgtctgtgcatctgtgttgtgcgtgtgaatgtatgcatttgggtctgtgtgtatgtttgtaatctgggtttgtgcatgtgcgtgtttgtatttgtgtctgttgtgtctatgtgtgtatgtttgggtatctgtgtttgtgtatgtgtatgtgaatatgtgtgtgtatttgtgtatgtttgtatgtctgtgtttgtgtatgtgagtatgtgcgtgtatttgtatatgttgtgtctgtgtgtatgtttgggtatctgtgtttgtgtatgtgaatatgagtgtgtatttgtgtatgttgtgtctgtgtgtatgtttgtatgtgtgtgcttgtgtatgtgtgtatgtgtgtgcttgtgtatatgtaaaagactgagttaaataattactaggtagcttctgtactggaagggcttaaaaagaaataattacttggtgattatcagaaataactttcatattaaagatacacaaaactcaaaatttttttcagactttacatgtttttaaaatctccttctgcctcttaccaaggatacagaaatgtatcccgtgaggggcatcttatttaaagtgtatgtttggtttctcctcctgacagcgtggcactgacaagatgtcttttatgaatgatgtgatggagaatggatttgaagtgcttactgtttagtggagagaaatacgtagataagccatcagagctaacactgattgagtgtttaccaggccccagtgtgtgctgttccccatcctgtgtccaagtgttctcattgttcaattcccacctgtgagtgagaacatgtggtgtttgtttttctgtccttgcaatagtttgctgagaatga

SEQ ID NO: 466787 - DNA, 2050 bp, Homo sapiens
atcgcttgcggctgcgcttgagcttgcataagtccttgtcgaagacctccccagagcgcagggccgacaccaggtcatcgaactctcctccctcctccagcgagctgcctgcagccaggaccttccgctgccgctgccaccgctcacgttccctctgctccttcagctgcgggcggggggccaaagataggaaccctctcagggagaggcgctgaggccagggcagccccccaaccctgggctaactcctaggccatggtcatgctgcctgcctgtatctgttggccccactttcttcctgcctaggacatacaggcccccagcttcacaccactctcttccctcaggctgggaagaagtttctctctcctggggctgacatccaacccctatggtgttcctcagttcctcagtctctgccctcctcccacacaccccagtttgggggtgttctccccaagtagcacccgtctcccctcagtcccaggcctggcactgcccctcaccatggcttccatgcgcgcccgccgctcctcctcctccttcctcctcctcatggcctctagatcctgccgggcctctgagaaggcctgcaagaaggtatcaaagatgccaaagaattcgtctggctgcatcttgctgtcatgctccccgaagtgcatcaaggccttggcgaactgtcaagggacagaacaggattggtggagagtgccctggagcatgctgggctcagcccctgaggttagctgggttctagccagagcagagcccagcgcaaggctggggactgttggcacagggggcagggctggaagaggtgagaagacacccccatcatcatcaggatcagagacaaggctaaggagaggcagctcggagaagctgaagctggacaccgtgatgaagtcgctcatgacagggacaaacttgtcactgggctcccgtacctggcgcctctgatactccagctcctgaggagggagggtgaagtgctgcttagactggtgccaagatgagagtcgggtgcaggggtcaccacatctcccctcgtcactcacaggacattgagccctttggaagagggaacaccctgcatctcaaagttctaaggatggcaaagactatgagctaacattagcagccagcccaccctgccatctttctttctctagagcactgagacccaacatgtgacctggggccagcagcatcacctaggaaattatgagaaatacagactctcagacccacaggatcagaagctgcattttaacaagactcatctttacaagactccaggagcttagggtgcagtgacgaacagtgtttgctgacagcagccctcacccagacaagaaccgaggtctcacaccagccatcatcaagcccagagtagaccccaaaagaggaaagtaagacaagaatgagggtcatcatggggagaaggaagtcttggagagaaccctcacttgactttggcagcttctggaagatgttgcagctctgaaggcatgtttagaatatcaggaaaatgcttctccaggatcatgatcagataactctccactctaagcctcctgcaaccctcagccctaccttccactttgggctttgcctcagccagccgctcctggaatttcttcttgaagaagagggcttgcagtcgctgctggtagtggtcaatcctgtagacaaggaggtcaatgtcactcttctctgggatgaacttgaggagctgcaaagagcaggcgcaagtcacacaagcaactggtttcccaaaggatccaaaaaactgagagggaagagatttggggaagatgtcacttttcctcatctgactttgccttggagtcagatgggagaatgactcctggagaacacttagccttttccagctttccccaagaaaggccggcccagggaggcttctataaaccttctccctaactcttccagcctgatttctccttgacccaagaatcgcagcctcctgggggctgttgggaaggggcgtggctgcccgctgggttcagttccccttccttcccac

SEQ ID NO: 466788 - DNA, 825 bp, Homo sapiens
ttcttgtgtatttattttagtcagtatttgtactcatttccctggagttatacctaagagtgggattactaggcaatagggcgggtatatgtttagctgtagagtgtacttccaagtagttttccaaaataattgtgccaaatgagaattccaattgcttcacatcctcgtcagcacatggcattgtcagtctttttaattttagctactctagtgggtgtgtggtgcccccttattgtggttgactgtatttctctgataactaatcatattgaacaccttttcatattcttattgtctatttggaaatcctctttcatgaagcaccccttcaagtcttctgctcatttttaagttgatttcatcattttctcattgatttgtagagttctttgttctgaatatgatctttgttatatgtatgtatagcaaatatcttcttctaaggtttgtcttcttttcactcagtaaccatgcccttgatgaacagaagttcttaactgtaatgaagtccaattgatgatgtttctttgtgtgttttctaggtttcccaaaggatccaaaaaactgagagggaagagatttggggaagatgtcacttttcctcatctgactttgccttggagtcagatgggagaatgactcctggagaacacttagccttttccagctttccccaagaaaggccggcccagggaggcttctataaaccttctccctaactcttccagcctgatttctccttgacccaagaatcgcagcctcctgggggctgttgggaaggggcgtggctgcccgctgggttcagttccccttccttcccac

SEQ ID NO: 466789 - DNA, 1960 bp, Homo sapiens
atcgcttgcggctgcgcttgagcttgcataagtccttgtcgaagacctccccagagcgcagggccgacaccaggtcatcgaactctcctccctcctccagcgagctgcctgcagccaggaccttccgctgccgctgccaccgctcacgttccctctgctccttcagctgcgggcggggggccaaagataggaaccctctcagggagaggcgctgaggccagggcagccccccaaccctgggctaactcctaggccatggtcatgctgcctgcctgtatctgttggccccactttcttcctgcctaggacatacaggcccccagcttcacaccactctcttccctcaggctgggaagaagtttctctctcctggggctgacatccaacccctatggtgttcctcagttcctcagtctctgccctcctcccacacaccccagtttgggggtgttctccccaagtagcacccgtctcccctcagtcccaggcctggcactgcccctcaccatggcttccatgcgcgcccgccgctcctcctcctccttcctcctcctcatggcctctagatcctgccgggcctctgagaaggcctgcaagaaggtatcaaagatgccaaagaattcgtctggctgcatcttgctgtcatgctccccgaagtgcatcaaggccttggcgaactgtcaagggacagaacaggattggtggagagtgccctggagcatgctgggctcagcccctgaggttagctgggttctagccagagcagagcccagcgcaaggctggggactgttggcacagggggcagggctggaagaggtgagaagacacccccatcatcatcaggatcagagacaaggctaaggagaggcagctcggagaagctgaagctggacaccgtgatgaagtcgctcatgacagggacaaacttgtcactgggctcccgtacctggcgcctctgatactccagctcctgaggagggagggtgaagtgctgcttagactggtgccaagatgagagtcgggtgcaggggtcaccacatctcccctcgtcactcacaggacattgagccctttggaagagggaacaccctgcatctcaaagttctaaggatggcaaagactatgagctaacattagcagccagcccaccctgccatctttctttctctagagcactgagacccaacatgtgacctggggccagcagcatcacctaggaaattatgagaaatacagactctcagacccacaggatcagaagctgcattttaacaagactcatctttacaagactccaggagcttagggtgcagtgacgaacagtgtttgctgacagcagccctcacccagacaagaaccgaggtctcacaccagccatcatcaagcccagagtagaccccaaaagaggaaagtaagacaagaatgagggtcatcatggggagaaggaagtcttggagagaaccctcacttgactttggcagcttctggaagatgttgcagctctgaaggcatgtttagaatatcaggaaaatgcttctccaggatcatgatcagataactctccactctaagcctcctgcaaccctcagccctaccttccactttgggctttgcctcagccagccgctcctggaatttcttcttgaagaagagggcttgcagtcgctgctggtagtggtcaatcctgtagacaaggaggtcaatgtcactcttctctgggatgaacttgaggagctgcaaagagcaggcgcaagtcacacaagcaactggtgagcagcagacatggggtacagggtgtgagaagctgtactgacttgggtcaagatggggagggtgccttgaaagagggaggcaccctcatgtggacagatttctttcatctgcctgaaggggatgacagggcacacagctctgaaattcttttttcttttttaaaattgagatgtaactgatatacag

SEQ ID NO: 466790 - DNA, 316 bp, Homo sapiens
gcagagccccacctgccccacctgccagaaccccacctgcttgaatccccaccatgcccatggcccaacctgctcatttcatagaggaagcggtcagcacgggccatccgctcaatttcatgcttgtgctcctccaggaggtcaatgtcactcttctctgggatgaacttgaggagctgcaaagagcaggcgcaagtcacacaagcaactggtgagcagcagacatggggtacagggtgtgagaagctgtactgacttgggtcaagatggggagggtgccttgaaagagggaggcaccctcatgtggacagatttc

SEQ ID NO: 466791 - DNA, 1909 bp, Homo sapiens
atcgcttgcggctgcgcttgagcttgcataagtccttgtcgaagacctccccagagcgcagggccgacaccaggtcatcgaactctcctccctcctccagcgagctgcctgcagccaggaccttccgctgccgctgccaccgctcacgttccctctgctccttcagctgcgggcggggggccaaagataggaaccctctcagggagaggcgctgaggccagggcagccccccaaccctgggctaactcctaggccatggtcatgctgcctgcctgtatctgttggccccactttcttcctgcctaggacatacaggcccccagcttcacaccactctcttccctcaggctgggaagaagtttctctctcctggggctgacatccaacccctatggtgttcctcagttcctcagtctctgccctcctcccacacaccccagtttgggggtgttctccccaagtagcacccgtctcccctcagtcccaggcctggcactgcccctcaccatggcttccatgcgcgcccgccgctcctcctcctccttcctcctcctcatggcctctagatcctgccgggcctctgagaaggcctgcaagaaggtatcaaagatgccaaagaattcgtctggctgcatcttgctgtcatgctccccgaagtgcatcaaggccttggcgaactgtcaagggacagaacaggattggtggagagtgccctggagcatgctgggctcagcccctgaggttagctgggttctagccagagcagagcccagcgcaaggctggggactgttggcacagggggcagggctggaagaggtgagaagacacccccatcatcatcaggatcagagacaaggctaaggagaggcagctcggagaagctgaagctggacaccgtgatgaagtcgctcatgacagggacaaacttgtcactgggctcccgtacctggcgcctctgatactccagctcctgaggagggagggtgaagtgctgcttagactggtgccaagatgagagtcgggtgcaggggtcaccacatctcccctcgtcactcacaggacattgagccctttggaagagggaacaccctgcatctcaaagttctaaggatggcaaagactatgagctaacattagcagccagcccaccctgccatctttctttctctagagcactgagacccaacatgtgacctggggccagcagcatcacctaggaaattatgagaaatacagactctcagacccacaggatcagaagctgcattttaacaagactcatctttacaagactccaggagcttagggtgcagtgacgaacagtgtttgctgacagcagccctcacccagacaagaaccgaggtctcacaccagccatcatcaagcccagagtagaccccaaaagaggaaagtaagacaagaatgagggtcatcatggggagaaggaagtcttggagagaaccctcacttgactttggcagcttctggaagatgttgcagctctgaaggcatgtttagaatatcaggaaaatgcttctccaggatcatgatcaggaggtcaatgtcactcttctctgggatgaacttgaggagctgcaaagagcaggcgcaagtcacacaagcaactggtttcccaaaggatccaaaaaactgagagggaagagatttggggaagatgtcacttttcctcatctgactttgccttggagtcagatgggagaatgactcctggagaacacttagccttttccagctttccccaagaaaggccggcccagggaggcttctataaaccttctccctaactcttccagcctgatttctccttgacccaagaatcgcagcctcctgggggctgttgggaaggggcgtggctgcccgctgggttcagttccccttccttcccac

SEQ ID NO: 466792 - DNA, 1468 bp, Homo sapiens
atcgcttgcggctgcgcttgagcttgcataagtccttgtcgaagacctccccagagcgcagggccgacaccaggtcatcgaactctcctccctcctccagcgagctgcctgcagccaggaccttccgctgccgctgccaccgctcacgttccctctgctccttcagctgcgggcggggggccaaagataggaaccctctcagggagaggcgctgaggccagggcagccccccaaccctgggctaactcctaggccatggtcatgctgcctgcctgtatctgttggccccactttcttcctgcctaggacatacaggcccccagcttcacaccactctcttccctcaggctgggaagaagtttctctctcctggggctgacatccaacccctatggtgttcctcagttcctcagtctctgccctcctcccacacaccccagtttgggggtgttctccccaagtagcacccgtctcccctcagtcccaggcctggcactgcccctcaccatggcttccatgcgcgcccgccgctcctcctcctccttcctcctcctcatggcctctagatcctgccgggcctctgagaaggcctgcaagaaggtatcaaagatgccaaagaattcgtctggctgcatcttgctgtcatgctccccgaagtgcatcaaggccttggcgaactgtcaagggacagaacaggattggtggagagtgccctggagcatgctgggctcagcccctgaggttagctgggttctagccagagcagagcccagcgcaaggctggggactgttggcacagggggcagggctggaagaggtgagaagacacccccatcatcatcaggatcagagacaaggctaaggagaggcagctcggagaagctgaagctggacaccgtgatgaagtcgctcatgacagggacaaacttgtcactgggctcccgtacctggcgcctctgatactccagctcctgaggagggagggtgaagtgctgcttagactggtgccaagatgagagtcgggtgcaggggtcaccacatctcccctcgtcactcacaggacattgagccctttggaagagggaacaccctgcatctcaaagttctaaggatggcaaagactatgagctaacattagcagccagcccaccctgccatctttctttctctagagcactgagacccaacatgtgacctggggccagcagcatcacctaggaaattatgagaaatacagactctcagacccacaggatcagaagctgcattttaacaagactcatctttacaagactccaggtgactcatgcacaaattaaagagacatttttctaaagctcccagctgattcagaagctgctggtccatgtaccgcactttgagtagcacttaacaggactataaaattgtaaatttggaaatcatcttcccccaccgtagtggcaacaaaacgttctttgtcatcctt

SEQ ID NO: 466793 - DNA, 1993 bp, Homo sapiens
aagcaggctggtccggccgggatgttaggatcagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataatacaaaaagaaaaacgagagagagaagaggacaagatgtccacagaggaatctgcattcgaggctgtttgcagaactaccgcgtttgtaaggactgtttcccactgggaactgtgtgtaattaatgagcagttttatgctttccctctcgtctgtgtacggtgtgattgttgtgtgtttcagaatctctattcagaaccaatagctggtaatgcctgctggctcgctgccctcaagttagcctctgaacgtgccctgcacctagagaagcagccttctcacccgcctcacctggctgctccagcggccaggccagccacctgaccatgaccattgctgatgtgcaacaggccttaattgaaaaaacacacaagtacatacatgcacatgcgcgcacacacacaggtgatttcacaggtagatctggtccctcttgctgtctccaatgctctagaaagcagcaagtaggcagctgacagtgttcccagggtgagtggcatctcccctcatcatcagaaagattcagtcaaattttggcccagagctgaagaggaggacttgggaatgtcagggaaaacatgacagggctaggggttaacaggcttctttggccaggagatggtttccagttcaccgtcaacccaaaagctctcttcaggtcatggcaaacagaccagggctgtgggtgtggctgtgcttggcactgactcccccacaggccgctgtccaggttggctcaggattccagctgccatccccaggcaggcccctccgctggctcggctgctttcacaatcaccatgtctgtctattagagactgtgccattcaaggagacggggtccccgggggtgcagacttgtaaaattttttaatttttcaacttggctgaactggtccccatcaacaggaaaagccttcggaagtgaatttacagatttctcccatgtttgaaattaacataacatgaacccagaaggcagagcttgcagtgagctgagatcgcaccagtgcactccagcctgggcaacagagtgagactctgtctaggtaggtaggtaagaaggaaggaaggaagaacagacctggatggagttattgggaacatgtcttatcaatgttgaagggccccctatcactgtagggagacatccacgtgggttgttttcgtctgctgtgaaaatctagggttggaatcatggaagcaaactgcaggaattcttaatcatcctgctcacgtggtgggcatcagagggtgtctgcttggcccccacagcactgggacagtcagagaggccatgagtggatgacgccctgatcactgccctttgcagtccaggaatacctcactgggctggggccataccctgtgccctctggaagacaagcctgcgcacttactatgtgccagatgccatgcacagtgccctagttccttgctgtagcaccaacacgtcccacgctggtgcttaaatgcacgcaaacaactttggtggttgtggcccgaaaagctcaaatgttaaagttaagcagtcaggcaagctagaagaggtgaggagcctcctagaaaactcattcgatgacacgcgcttccctcacctattcagatacttgccga

SEQ ID NO: 466794 - DNA, 1294 bp, Homo sapiens
gggctgtaccggcccgggagtttgggagccttaattgaaaaaacacacaagtacatacatgcacatgcgcgcacacacacaggtgatttcacaggtagatctggtccctcttgctgtctccaatgctctagaaagcagcaagtaggcagctgacagtgttcccagggtgagtggcatctcccctcatcatcagaaagattcagtcaaattttggcccagagctgaagaggaggacttgggaatgtcagggaaaacatgacagggctaggggttaacaggcttctttggccaggagatggtttccagttcaccgtcaacccaaaagctctcttcaggtcatggcaaacagaccagggctgtgggtgtggctgtgcttggcactgactcccccacaggccgctgtccaggttggctcaggattccagctgccatccccaggcaggcccctccgctggctcggctgctttcacaatcaccatgtctgtctattagagactgtgccattcaaggagacggggtccccgggggtgcagacttgtaaaattttttaatttttcaacttggctgaactggtccccatcaacaggaaaagccttcggaagtgaatttacagatttctcccatgtttgaaattaacataacatgaacccagaaggcagagcttgcagtgagctgagatcgcaccagtgcactccagcctgggcaacagagtgagactctgtctaggtaggtaggtaagaaggaaggaaggaagaacagacctggatggagttattgggaacatgtcttatcaatgttgaagggccccctatcactgtagggagacatccacgtgggttgttttcgtctgctgtgaaaatctagggttggaatcatggaagcaaactgcaggaattcttaatcatcctgctcacgtggtgggcatcagagggtgtctgcttggcccccacagcactgggacagtcagagaggccatgagtggatgacgccctgatcactgccctttgcagtccaggaatacctcactgggctggggccataccctgtgccctctggaagacaagcctgcgcacttactatgtgccagatgccatgcacagtgccctagttccttgctgtagcaccaacacgtcccacgctggtgcttaaatgcacgcaaacaactttggtggttgtggcccgaaaagctcaaatgttaaagttaagcagtcaggcaagctagaagaggtgaggagcctcctagaaaactcattcgatgacacgcgcttccctcacctattcagatacttgccga

SEQ ID NO: 466795 - DNA, 2576 bp, Homo sapiens
gttgttacatgtactgtctcatgtcctcacatgtagcagatgagtaaactgaggtggctggtagcgggttcaggtgttggctgggggtgtcagttgctcaccaggcagaaggaacggctagtgcaaagatcctgcggcagccacaggcttggtggtttcaaggaagcacaagaaagccaggtggcacaagaaagccaggtggctggggacccagagggaaggcagaaggagatgagggtgatagtgcccagctctgggctctgctcccagctgcggaagccacagctgtgtcccacgtgcagtgcctcagaaggcagaggaagccttgaggtgggggcccaagacccagattctgacatcagctctgccactgagaacagcgtgacctcaggcaagtccctcttgggcagctgggctgaggactggaacattctgtggcaagcaggaggcctcagcagagatcaccaagacccagcacacctggtgcagacagccacggcatcctccttcctgcaggtcacccccacgagccacttaacctctcagagcctctgcttctcacctgtcaagtgtgtgaggtagggtaccagttagtcacggtacttgctgtctcacagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataatacaaaaagaaaaacgagagagagaagaggacaagatgtccacagaggaatctgcattcgaggctgtttgcagaactaccgcgtttgtaaggactgtttcccactgggaactgtgtgtaattaatgagcagttttatgctttccctctcgtctgtgtacggtgtgattgttgtgtgtttcagaatctctattcagaaccaatagctggtaatgcctgctggctcgctgccctcaagttagcctctgaacgtgccctgcacctagagaagcagccttctcacccgcctcacctggctgctccagcggccaggccagccacctgaccatgaccattgctgatgtgcaacaggccttaattgaaaaaacacacaagtacatacatgcacatgcgcgcacacacacaggtgatttcacaggtagatctggtccctcttgctgtctccaatgctctagaaagcagcaagtaggcagctgacagtgttcccagggtgagtggcatctcccctcatcatcagaaagattcagtcaaattttggcccagagctgaagaggaggacttgggaatgtcagggaaaacatgacagggctaggggttaacaggcttctttggccaggagatggtttccagttcaccgtcaacccaaaagctctcttcaggtcatggcaaacagaccagggctgtgggtgtggctgtgcttggcactgactcccccacaggccgctgtccaggttggctcaggattccagctgccatccccaggcaggcccctccgctggctcggctgctttcacaatcaccatgtctgtctattagagactgtgccattcaaggagacggggtccccgggggtgcagacttgtaaaattttttaatttttcaacttggctgaactggtccccatcaacaggaaaagccttcggaagtgaatttacagatttctcccatgtttgaaattaacataacatgaacccagaaggcagagcttgcagtgagctgagatcgcaccagtgcactccagcctgggcaacagagtgagactctgtctaggtaggtaggtaagaaggaaggaaggaagaacagacctggatggagttattgggaacatgtcttatcaatgttgaagggccccctatcactgtagggagacatccacgtgggttgttttcgtctgctgtgaaaatctagggttggaatcatggaagcaaactgcaggaattcttaatcatcctgctcacgtggtgggcatcagagggtgtctgcttggcccccacagcactgggacagtcagagaggccatgagtggatgacgccctgatcactgccctttgcagtccaggaatacctcactgggctggggccataccctgtgccctctggaagacaagcctgcgcacttactatgtgccagatgccatgcacagtgccctagttccttgctgtagcaccaacacgtcccacgctggtgcttaaatgcacgcaaacaactttggtggttgtggcccgaaaagctcaaatgttaaagttaagcagtcaggcaagctagaagaggtgaggagcctcctagaaaactcattcgatgacacgcgcttccctcacctattcagatacttgccga

SEQ ID NO: 466796 - DNA, 812 bp, Homo sapiens
tcccatgcacacgccagcgtgcagtgtgtgtgcattgcatatgtatcagtgtgcatgtgtatgcaagagcaattgtcagtgtgtcatgtgtatgagtgtgtatgtgtgtgtcagtgcatatgtgtgtaagtgtgtcagtgtgcatgtgctacacaggaagcacgacccagtatctgctcctggtgaggcctcagggagcttttactcttggtggaagatgaagcaggaacagataagaaaactgagacacagaaaagtcacacaagattatcgaggtcaacacagagaacagtggaacctgcacctgaccccaggcaggcggaaccttcatgaccacaccacaccaccacagggaacaggcagggaaaacaatgggtctagcaggacaaaagtgacatttcccagagtttcttgctgtttggatctggctgcagtttcagttttgccaagaagaggcatttccatgagctctggacagtggcagagaggcagaggtgctccactgcagtgtgctggatggtccacgggctcctgccaatgtgaggatttgcagcaactggtatatccatggtcttgtcaccagcttcctgaattcggggcagctggagccacactagtggtccttccttgcaggggcagcagctgtctcctggtctcagaatcacagctgtggggatgcaaccttaagccaaaagcctagcggtgggtggtcctaaacttcttttgtctaggccctctgatccctctgtaagtcgctatttcccttattaaatctctttctgctggaaaaaataaaaagggagccgcctaag

SEQ ID NO: 466797 - DNA, 931 bp, Homo sapiens
tcccatgcacacgccagcgtgcagtgtgtgtgcattgcatatgtatcagtgtgcatgtgtatgcaagagcaattgtcagtgtgtcatgtgtatgagtgtgtatgtgtgtgtcagtgcatatgtgtgtaagtgtgtcagtgtgcatgtgctacacaggaagcacgacccagtatctgctcctggtgaggcctcagggagcttttactcttggtggaagatgaagcaggaacagataagaaaactgagacacagaaaagtcacacaagattatcgaggtcaacacagagaacagtggaacctgcacctgaccccaggcaggcggaaccttcatgaccacaccacaccaccacagggaacaggcagggaaaacaatgggtctagcaggacaaaagtgacatttcccagagtttcttgctgtttggatctggctgcagtttcagttttgccaagaagaggcatttccatgagctctggacagtggcagagaggcagaggtgctccactgcagtgtgctggatggtccacgggctcctgccaatgtgaggatttgcagcaactggtatatccatggtcttgtcaccagcttcctgaattcggggcagctggagccacactagtggtccttccttgcaggggcagcagctgtctcctggtctcagaatcacagctgtggggatgcaaccttaagccaaaagcctagcggtgggtggtcctaaacttcttttgtctaggccctctgatccctctgtaagtcgctatttcccttattaaatctctttctgctggatactttgggtgtttctactttctacacagaatgctgattgacatataggacacggctgggacaggtggatgctgggctgaacaaaggaggggcctgggcctgattcagaggccaaggaagactctgacactggtgtctgtgatg

SEQ ID NO: 466798 - DNA, 2848 bp, Homo sapiens
ctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgacttctgctgctcccacctcctgggcatggttgggcagttggagcggctgagcctaagcatcctgcacccggcctacgcgcccatcgagcacgtcaagcagcagctgcaggatgctctgccccccgacgcccacgtcctggcctcccagcggctgggcatttcgctgacccgctggcctgacggacgcaacttcttggtcactgacttcgccacctgcgatgagctcatccaggccttggtctgcaccttatactttcctttctactgcgggctgatcccccccgagttcagaggggagcgctacatcgatggggctctgagcaacaacttgccctttgcagactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaaggttggtggtgtggctgcccgatgtgccggcggacttgtggtggatgcagggcctgctgaggaacatggccctcgaggttttctccaggaccaaggcccagctccttgggcccatcagccctccggccactcgcgtcctggaaacaagccccctccaaccccagatagctcctcatagagaggagctcgggcccacccaccaggcctgagggggccgagcagggccagcccagtgactggtgtcccttgattcctgctctggcctttgtcctgtgtgcccacatctgccccagcgggaagaggccctgccaatctccgtggagaccctgcagcttggagcccgttccttggggcgcagcctgtcagcatgtccccggtcactgtgtacccaggtcacctgccctccctcttgccccgtctcatcagggagagaaaggaggacagccacagagacacatgtcttactttcagaatttccacggggggactaggagggcagcattgctggggagaggggctcctgttctgccgtggagctgcccacggagcacctcacagaagattgagaaagtgcctgatgcccgcgtcagagaccagaggagccaactgagatgatggggtgggggtgctccccccagactttctcagtcctgcagcggcccttgggggtgacccccggcatctaccccactcaggaaaccttgacttctgaattcctatcaggtccagagggtggaaggccctggcaggaagcaggaggaggaggagaggggggtccaggtcttttcaggatcccagctgtgggtgcttctgttgggcccagtggcccctgctatccccacagcctcattcctgcagaaggtttgtgacgtagctgtgcctgtacctggggcagagaggatgccagggacaccaggcctctggcctctccacgagtcactgctctccccattggcagcacgggacccatgctgtgcccccggccaggccctgaggaaatgctcagcctcagtggagatggggaggttagagagatggaggcgtgagtgagaacgggaagcaaaggaatacacgtgggaactaaagagaaaaatgaccagcctgggcagcatagcaagaccctgtctctaaaaaaaataataaaaacttagctgggcatggtggtgcatgcctgtggtcctggctacttgggaggctgaggatggaggatcatttgagcccaggaggtcgaggctgcagtgaaccgtgatcacgccactgcaccccagcccaggcaacaaagtgagcccctgtctctaaataaataaagagacaataagccactcattcattctttcattcatttatcagcttatgcttagaccccctgggtctgagcaggactctgcccctctggccatctcctgggtgggggcagccagaaacctctctgagccctggagccctggagccctggagcagctatggtgcccgtttgtgggccacattcctgggcctgctacaagcctccctgcctggctttctgagcaccagttgtgtgctgggtgtttcctgctgcctgaggcagatcccttccccaaggagctcctgtgcctttaatgctgtctccatggaggtaacaggtaatgcagccctcacaagtacacatcacct

SEQ ID NO: 466799 - DNA, 1239 bp, Homo sapiens
gccaccttggcagctttttaatcaaagaccaggcagttgtttccttgaaaagtcaggccacaagaaacctggatgcttgtgcttacatcctgacactctgggaatggaaagatggagcaggaagctcataccccatggctccaggggtagaagagagctaaaagttcagaaaaaggaatccacggtgtcaacaggccaagtttgaatttgggcaggagatcagcctgggtgggccccatgagtgtgccagtctgatatggtgagataagcctgggacagatgtgctgccgcattcgtgactagaaaagagtccccaggaatttctggctcctgccttcagattgtgaactttccaggttggtagatcagcttaggtagaacagttctcggtgagggccagctacatacctggctaagcgctgcccactgcagaaaagctcatcacccgggacctgatctccaggactcagaagcacttggaggaaggcctattcacttagaagcagttaccagtgctgggcagtgtcctccaagtgccagaggagtgctgtggagaaaagaagtccatggaagccaggagatgggcaagattttgcctcttcaaggtgaatgcggcttcaaggggctatctttgtgctcctgccccacctggggcccatcctggtctggctgttcactcgtgatcacatgtctggttggtgtgagggcccgaggatgctgtcctggtgcccattctacaaagtcttattgcttgtacagacagccatctactctgtcgtgggctatgcctcctacctggtgtggaaggacctgggagggggcttggggtggcccctggccctgcctcttggcctctatgctgttcagctcaccatcagctggactgtcctggttctctttttcacagtccacaaccctggtctgctgacccccggcctctatgcccaggccctgctgcacctgctgctgctgtatgggctggtgaatggaaacatagagaggctagacaagtaccagaaaaatccccctagcgtccacttgcacctactctaacacatttctcattttaagggctgaaattcccctctcaagttgattgtagtttgtcacctcttcccaggagtgagaatttaaaccttcctctggtgaggcttctattttccaccagccctgctcctggcctctctgctcccttcccaatgagggcagctccacatccagccaagatccaaggaacaa

SEQ ID NO: 466800 - DNA, 2188 bp, Homo sapiens
aagcaagcaaagaccgcggtcccggatcctgcaacttctacctcattttctccaggcctctccacttgcccgagctctcagccaccaggagacagacggaaggggcttctggattgcgttgggagcgggcactgtcccctacccactcctgctcagtttcccaaagtccagcgacttccgaccctccttggggggaaaaataccagtacccagacacctttgcaccctgttatatgactgggcttgcttcaggaatatcttacaaagaagaagaagaagaaagaacggcttggagtcatgtttacatctagttctactgatccgttcacatctggagagtttatttataactccctctataactctctgtttggagacactgtggctctattgacagactgatatctaggaaatattgctctatgtctaaccgtacctaaatgtgctgtggttgtatttacagatttatgtttgagggaaatataactatttccattgtatttgtgcatatacagtagttataggagcagatttatatatgggaaaatatacgactctcttacagccatccagctttatgtacatttgatatcctgacagatttatatctctgaacagctatatagataaaaacgtatattgttagaattatgtatcagaagatatatacttattgattgtgaaatagagtagttagagcattcatttagagccatatatggctatggagatattgctatattattatcactatatataggcatatctatttataactacatagttataaaaatacatataagtaattacagtcctatatgtgcatgctgcaatctctctctagagttatagacactttcaaatataactctatagagagatctgtatgcatataaggtgtaattatcttgtgatgtgtttacattgggacttaggcccgtctgtctagaacacacatatttatatgtaggggctgggagagacttgttcatagatatctgcagagggccaactggaaacactgtatctgccctctaggaaaccagctaggagagttgtgtacttacggagggatggagttacaaaaggagatcagcggacccacgtcagagaagatgtttgagtcttttcgcggctcttctctgagaaatgaagccacaccacgatacagtcagcaagaggaagccaggaatgagagatggcaacaatccctgtccctggaacgctggcctccctgcacaagccaccctttaggaaccccaccccttatgcctgtgacggtggcaagccgaagttgcgtcagggctgccagggccttggagggttggggttggggcgaattttgcagaaacctctttgctcctccggtaggcattcgaaaacgtggcttggaacgaccctcgggcgagagagcagcccaggggcatgcaggccgaactgtcctagagatcacggaccgaggcacgaattctggggagactcaccccaaccaacaccatccgggcaggcctgaggctgggttcctgtgctgcttcccccgtctccgctgggctttcctcatggtggtcggccctttgcgactcctggcatctggagacattcccgtcgaccccgtgaagttgttaggccggagcctcagatccccgaaacccaagcacgccagggagggctcctgcttcgccaagcctcggagactggtttctaagacaaccgtgggaaccactgtgacgggagaagccgctcgcgcctcgcgcatgcgcattggctgcaaattcactgatccatcagccctctgcctccctcctcctttgaaagagcagtggcctgccccgcttctaaaagccctggggatccggaaagccgaccgcgctttacaggtcaactgcaaagaggaacagaggcgaatcctaggtggagaccatgtgaccacgcgtggcactggcctatcccacagcaagaagagccatgaaaagacacaagcatcttctctgacgtgggtccgctgctctcctgtgggacaaagagctcctgttggggctcttgtcctcgtctgcagtggactgcgggattctactctcgacgagaacgaccctcggatgagagagcagcccaggggcacgcaggccgacctgtcttagagatcacggatggcggcacgacttttggggagagtcaacccaaccaacac

SEQ ID NO: 466801 - DNA, 3481 bp, Homo sapiens
ttctggagggcctcaggaagagctactgggaagtctcagcctgtggcctggctgggtagccaggtgagcaggaggcctttggctttggctggcacaggggtgaaggagagccagcggcattgagtaaccaggcgaatgtgcccccaggagagttcattccaaccctcccagttcctactgctggtgggggtcccagtggcaagtgtcctccttctggcccaatgccttcgatggcactgccctagaaggctgctgggggcctgctggacactgaatggtcaagaggaaccagtgtcccagcctaccccccaactagaaaatgaggtctcaaggcagcacctgccagccacactgccagagatggttgccttctaccaggagctacacacacccactcaaggccagaccatggtccgccagttgatgcacaaactgttggtgttttcggctcgagaggtggatcaccgcggcggttgcctgatgctccaggatacaggcatctccttgctcatcccaccaggtgctgtggctgtgggccgccaggagcgggtgtctttgatcctggtgtgggacctgtcggacgccccatcgctgtcccaagcccaggggctggtaagccctgtggtggcatgtggcccccatggggcctccttcctgaagccttgcactctcacgttcaaacactgtgccgagcagcccagccatgctcgcacctacagcagcaacactaccctgctggatgccaaggtatggaggcccctggggcggccgggggcccacgcctcccgggatgagtgtcgcatccacctctcccacttcagcctctacacctgtgtgctggaggcacctgtggggcgcgaagcccgcaaatggctgcagctggccgtattctgctcaccgctggtgccaggacagtcccatctgcaactgcgtatctacttcctcaacaacacgccctgcgccctgcagtgggcactgaccaacgagcagccccatggtgggcgcctgcgtgggccctgccagctcttcgacttcaatggggctaggggcgaccagtgcctgaagctcacgtacatctcagagggttgggagaatgtggatgacagcagttgccagctggttccccatctccacatctggcatggaaagtgccccttccgctccttctgcttccggagaaaagcagccgatgagaatgaggactgttcagcactaaccaatgagatcattgtcaccatgcacaccttccaggatggcttggagaccaagtatatggaaatcctcagattccaggcatcagaggaggaatcctgggcagcgccaccacctgtttcccagccgcccccatgcaataggctgcccccagagctctttgagcagctgcggatgttattggagccaaacagcatcaccggcaatgactggcgcagactggcctcccacctggggctttgcggcatgaagatccggttcctgtcctgccagcgcagccccgcagcggccatcctggagttgtttgaggagcagaacggcagcctgcaggagctgcactacctcatgaccgtcatggagcggctagactgcgcctccgccatccagaactacctgagtgggacacacggcggcagcccaggccccgagcgcgggggcgcccgggataaccagggcctggagctggacgagaagctctgagcgcccagcgggcagggccggaggagaaaacattaaagctgagtagaaacttcaagatgatcattctggcccagcccttttatctctttatctccaatggtgtgcgttttaagtttctctgacttggtttttctgtccctgtctcccacagttgttcccgctctgcacctgtgtttcagttactctctctctctgtcttagatctttttgtttctgcctagtctctgtgccctgtctttgtgtgtttctttctctgcctgaaaccctccctcttttcccttcaggcatatgtctctaaaccaatgttatgtatcaaagactgttgaaagagacagggctactctaggaatggatgggtggggatattttccccatggatcaagatccagtttagggttgggaaataaaggatagggataaaagaggcaccccattcagtcagcagatacttattcagcacctactatgtgtttgatactgtatacaaaagacatgaatgggctgggtcctgaacagagaataaagggtttgactccattctggaaattcttttgtttgcaaacaggtgttgttaatttgttcaaaggcaggcaaacaatctctctggcaacacaattttcttctgtatttaattaaaaaatattaaagctttttttctatgatgaatgataaaatatgaaaattgccttcctttgttactaactatattttgctcagattggcaaatttggatgtgagtatgaatgattttatttggtaaaattgtacctatggggatgggttggagggaagcattttgtagattgtgcttccagtatgaaaattacctgggtcccgcatggtaagtcagggaggttcccttccttttctgttagatgcaagccttcagaagcaggcctttccatcccttccctgttcccctatccccaccagtcctctcctacccttctcatctgtcctccttaccccatcgggtgctgccagtcacgccagattagtgccccggacttttcccccttcacttagctcaggattgaactgtgcagtagcccggcactgtttagccaaagacatcattgtgttccttcctaccctggaaaaaatcattttaagagtttcacatctactggagttgcaaatagaagccacacagattccagtgatgggaatagaatgctttctggccccaactccaatttctcaaaatgcgtttccagtgctggcaaagggaggcttggaaatcctggggtagatgcaggccaagtgattcctataaggcagacacttcctttctcacatcaaacccatttggcatgttatgtattggcacctaatgctgagagatggtgtgccccagtgagcatcaggagacttaacatttagccctgactcatactaactagaacagctcttctttgtgctttaaactcttccttggaatgaagctaccatattagaggctgtcccagggcctttgatttcatagacttatgcagaggtggcacactggtcacccaaggaacgttcacttggggatttttttttctttttgaattgccttcaaatagcaaacaattgatcactgcttgtggccttacttccagccctttccctgatgaagagttgcctaaatcacctgctgaaaaacactgcgtttgtgatttctgctttttcacatgttgcagaggcccacgtctacacttcctcctgctggatttggagtctggggaaaggcgatggggaaatgaaagggtaaggttgggcctaggtctgtggggttggagcctct

SEQ ID NO: 466802 - DNA, 3445 bp, Homo sapiens
aactggaccagccagcagcctctaagagctcctagacggcctttggctttggctggcacaggggtgaaggagagccagcggcattgagtaaccaggcgaatgtgcccccaggagagttcattccaaccctcccagttcctactgctggtgggggtcccagtggcaagtgtcctccttctggcccaatgccttcgatggcactgccctagaaggctgctgggggcctgctggacactgaatggtcaagaggaaccagtgtcccagcctaccccccaactagaaaatgaggtctcaaggcagcacctgccagccacactgccagagatggttgccttctaccaggagctacacacacccactcaaggccagaccatggtccgccagttgatgcacaaactgttggtgttttcggctcgagaggtggatcaccgcggcggttgcctgatgctccaggatacaggcatctccttgctcatcccaccaggtgctgtggctgtgggccgccaggagcgggtgtctttgatcctggtgtgggacctgtcggacgccccatcgctgtcccaagcccaggggctggtaagccctgtggtggcatgtggcccccatggggcctccttcctgaagccttgcactctcacgttcaaacactgtgccgagcagcccagccatgctcgcacctacagcagcaacactaccctgctggatgccaaggtatggaggcccctggggcggccgggggcccacgcctcccgggatgagtgtcgcatccacctctcccacttcagcctctacacctgtgtgctggaggcacctgtggggcgcgaagcccgcaaatggctgcagctggccgtattctgctcaccgctggtgccaggacagtcccatctgcaactgcgtatctacttcctcaacaacacgccctgcgccctgcagtgggcactgaccaacgagcagccccatggtgggcgcctgcgtgggccctgccagctcttcgacttcaatggggctaggggcgaccagtgcctgaagctcacgtacatctcagagggttgggagaatgtggatgacagcagttgccagctggttccccatctccacatctggcatggaaagtgccccttccgctccttctgcttccggagaaaagcagccgatgagaatgaggactgttcagcactaaccaatgagatcattgtcaccatgcacaccttccaggatggcttggagaccaagtatatggaaatcctcagattccaggcatcagaggaggaatcctgggcagcgccaccacctgtttcccagccgcccccatgcaataggctgcccccagagctctttgagcagctgcggatgttattggagccaaacagcatcaccggcaatgactggcgcagactggcctcccacctggggctttgcggcatgaagatccggttcctgtcctgccagcgcagccccgcagcggccatcctggagttgtttgaggagcagaacggcagcctgcaggagctgcactacctcatgaccgtcatggagcggctagactgcgcctccgccatccagaactacctgagtgggacacacggcggcagcccaggccccgagcgcgggggcgcccgggataaccagggcctggagctggacgagaagctctgagcgcccagcgggcagggccggaggagaaaacattaaagctgagtagaaacttcaagatgatcattctggcccagcccttttatctctttatctccaatggtgtgcgttttaagtttctctgacttggtttttctgtccctgtctcccacagttgttcccgctctgcacctgtgtttcagttactctctctctctgtcttagatctttttgtttctgcctagtctctgtgccctgtctttgtgtgtttctttctctgcctgaaaccctccctcttttcccttcaggcatatgtctctaaaccaatgttatgtatcaaagactgttgaaagagacagggctactctaggaatggatgggtggggatattttccccatggatcaagatccagtttagggttgggaaataaaggatagggataaaagaggcaccccattcagtcagcagatacttattcagcacctactatgtgtttgatactgtatacaaaagacatgaatgggctgggtcctgaacagagaataaagggtttgactccattctggaaattcttttgtttgcaaacaggtgttgttaatttgttcaaaggcaggcaaacaatctctctggcaacacaattttcttctgtatttaattaaaaaatattaaagctttttttctatgatgaatgataaaatatgaaaattgccttcctttgttactaactatattttgctcagattggcaaatttggatgtgagtatgaatgattttatttggtaaaattgtacctatggggatgggttggagggaagcattttgtagattgtgcttccagtatgaaaattacctgggtcccgcatggtaagtcagggaggttcccttccttttctgttagatgcaagccttcagaagcaggcctttccatcccttccctgttcccctatccccaccagtcctctcctacccttctcatctgtcctccttaccccatcgggtgctgccagtcacgccagattagtgccccggacttttcccccttcacttagctcaggattgaactgtgcagtagcccggcactgtttagccaaagacatcattgtgttccttcctaccctggaaaaaatcattttaagagtttcacatctactggagttgcaaatagaagccacacagattccagtgatgggaatagaatgctttctggccccaactccaatttctcaaaatgcgtttccagtgctggcaaagggaggcttggaaatcctggggtagatgcaggccaagtgattcctataaggcagacacttcctttctcacatcaaacccatttggcatgttatgtattggcacctaatgctgagagatggtgtgccccagtgagcatcaggagacttaacatttagccctgactcatactaactagaacagctcttctttgtgctttaaactcttccttggaatgaagctaccatattagaggctgtcccagggcctttgatttcatagacttatgcagaggtggcacactggtcacccaaggaacgttcacttggggatttttttttctttttgaattgccttcaaatagcaaacaattgatcactgcttgtggccttacttccagccctttccctgatgaagagttgcctaaatcacctgctgaaaaacactgcgtttgtgatttctgctttttcacatgttgcagaggcccacgtctacacttcctcctgctggatttggagtctggggaaaggcgatggggaaatgaaagggtaaggttgggcctaggtctgtggggttggagcctct

SEQ ID NO: 466803 - DNA, 1958 bp, Homo sapiens
acaaggagaaggtgggcccagcaagcccagaggacacagccaccaggactgtcacccactcctggggaagggcgggaaggtgctgtctccggggttgtcagaaaagtccagaatcctcctggagttgaagtctctctgcggggccaggatggcgaggaactggaaccctggagcctgtcatgttactccaaggctgactagtcccagtccccagtgagaagcaaggagaacctgatacaggcggtggcccggcttggaatgagcagaacaacctagacccgtctggctttgggagtcagaggctcggcttcaaatcccagctccaccttggtcacctgcaggaccctgagccgtagaggattaacccagtcggcgtgcagggggcgtggcctgtgcctcactgcaggtacccctcctgtccctcccgcagcactgatgacaggccggctgtgctgggcaccgagaatgcaccggccctgctctcgcagggcccacagaccagggagggaggaagatcataaataaatgaagtgagcaaggcaccgtgcatgtattctaccagtgtctacagagcccatgctctgagccaggcactagtctagtaaataaacatcgctaacgtgtttcagacacttgccttatcctccagcctcaacctctgttacccatgaagtctcacaataggcctagggggtggccctcttgtaaccccatcttacaggagaggaaacagaggcccagagaggctaagctccttgccatgctgttaggcagtgacggagcctgcacccataatcgcttgtacccagaactccaccgctgtctatcggttgggcagacagaggctgccttgcctggctgccaacacgaaatggcattttgctcgaggtgttcctcctccctcgcctttccctgcctctaaattcagagcaaaggtagcatgagtcacgactcatcgacacggtgagggacaagcatgctccgccagggaggggctttgtgcggtctgaaccggggactgcagcaaacgatcgcgcagcggggactcaagcccctgatggtgccagaaaaatataacaataacagaaataaacaccaaacccacaaaagctcagtgcagaaggcccagagtccaagagcgcccatagtaggagcattgccatcttggacgagcaccttgatcaaaaactgcctaaatccaaagggcatcagcctaacggccaagctgcaagctctctccctgaagctgcctttaattgggttgagaaggcacgatttgccaggtgcacactcctttgaaatcaggggtgaccctatgacctgctctgtctgcagaagtgatgagtcacctccagggagaagcattaaggaccactctgcctacccctttccactgtaacggacagggtggccccgcactcccgacttgctgctccgggatgttggtgctccagtcagctggggcagctgagccatccctgggagactgtggctctggggaatcacctgcacctgtcgtggactttgcttgggcagaaacacatgtttgactgaagccactgggactttgacagtttgttcctgcagcatcgttgaaatcaacctgatcgatgcaaatatattgtcaagttgaaatgcaggtttcaaaatggcattgattcatccatcagttattcattgggcccccaccttcccaccccatgtctgcaatttccaattccagatttaggggagggggcgtttagagtccaaatccctcccccaacacacacgtaggaaaacgaatgtggggataacagggccgcactgtggcgatggcggtgaggcagggaatggcagtcctggtatgcagtagggcctcgctcaatctcagctcctttctgaacttttcctgcccacacacctgtcctcgggcctcatccaggtgtcagggacaaaaagcattttaatagggcagg

SEQ ID NO: 466804 - DNA, 983 bp, Homo sapiens
caactctgttagcaaagctgtttgtctttctcggaaacaacagtaacgataagcctctttgaatatggaggccgctgcagacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcggatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggccagtggtccagacaatgtacaaagcctgcccctgtggcccttgccaaagggccagatgtcaagagagaagcaaccagatccggagtcggcccctagccagaagctcaccggaatagcccagccaaagaaaaaggtcaagatttctatcacttccccgtcttctccagaacttgtgtctccagaggagtacgccgacttcagcagcttcctgctgctagtcgatgcagcagtacaaacggctgccgagctggagctagagaagaagcaagagcctaatccatgattgatgatgttccaaaaacccaagtagtcagtcccttgtgtactgtggtaaacctgtttatgttcaccccaacttatttgtatgcttatcttttatagaggcatctttctttctactggttttatgagtaccaatcttaattattgggactaaattctgtcagatatttcagtgtttccaggtgaaagacacta

SEQ ID NO: 466805 - DNA, 1133 bp, Homo sapiens
ccctgtagtgtcccaaaacaggatgcataggaccagaggcccggatcctgaggctgtttgtcctactgaaaagcacctccactttctgtttctctggacagacaagggttacacaggggaagaaggtggcaaggtggacacctttggcagtgggggctggcagcagggcccggaggggcacgtggtggggctgggcttccagtgggagcagtgtgacagagggcgggtggggcagcggggctgtcacagggacagggtggggcagcaggggaatagggaggatggtttctggataaaactatactacttcaggtcatcctcaagctttacattctccacagacaggggacccattccaattaaaagaagtccatcttcaagaaatggaggtcctcctcctacaaaatctgctcctgtgacaagaagcaatagtcggatgggaggccaagatcgacgaagtgattggattgaggctgacattccttttcatcctgtgttgctagcagattcatcttaatttttctaaaagctcctagaagtattctttgatggtcccatatcatatggaagagagaattatggaggtcctccatgcagaaagccaatctcttcctggcaaataaccatatgtcaccaagagatgacggttatgcaactaaggatggggacctctcatggtgcaccacctgcacaagggcctcggatgtcttatggtggaagaagccgccattattataacaatacacgagatagatatagcagaagtcggagagttactcaagacactgtggtgatttttattcctgttttcatgagcacgttggcagaaaagaccaaaggaatctaatttctctggatagagtgcaccctgctcctcgtgaagcatatggtagctcaagttatgtggcatctacaggagatggtgggaattgaaaaatgagatcacatggacacaggaaggggaacatcacactctggggaatgttgtggggttggggaagaggggagggataacattaggagatatacctaatgctaaatgatgagttaatgggtgcagcacaccaggatggcacatgtatacatacgtaactaacctgcacattatgcacatgtaccctaaaacttaaagt

SEQ ID NO: 466806 - DNA, 1019 bp, Homo sapiens
ccctgtagtgtcccaaaacaggatgcataggaccagaggcccggatcctgaggctgtttgtcctactgaaaagcacctccactttctgtttctctggacagacaagggttacacaggggaagaaggtggcaaggtggacacctttggcagtgggggctggcagcagggcccggaggggcacgtggtggggctgggcttccagtgggagcagtgtgacagagggcgggtggggcagcggggctgtcacagggacagggtggggcagcaggggaatagggaggatggtttctggataaaactatactacttcaggtcatcctcaagctttacattctccacagacaggggacccattccaattaaaagaagtccatcttcaagaaatggaggtcctcctcctacaaaatctgctcctgtgacaagaagcaatagtcggatgggaggccaagatcgacgaagtgattggattgaggctgacattccttttcatcctgtgttgctagcagattcatcttaatttttctaaaagctcctagaagtattctttgatgggacctctcatggtgcaccacctgcacaagggcctcggatgtcttatggtggaagaagccgccattattataacaatacacgagatagatatagcagaagtcggagagttactcaagacactgtggtgatttttattcctgttttcatgagcacgttggcagaaaagaccaaaggaatctaatttctctggatagagtgcaccctgctcctcgtgaagcatatggtagctcaagttatgtggcatctacaggagatggtgggaattgaaaaatgagatcacatggacacaggaaggggaacatcacactctggggaatgttgtggggttggggaagaggggagggataacattaggagatatacctaatgctaaatgatgagttaatgggtgcagcacaccaggatggcacatgtatacatacgtaactaacctgcacattatgcacatgtaccctaaaacttaaagt

SEQ ID NO: 466807 - DNA, 1418 bp, Homo sapiens
cttagtgagcacgtgggtgtcacagttgccgtaatagtctcatacagggcacaaagctctccaaatgtccacttgcagattctatgaaaagagagtttcaaaaatgctcaagcaaaagaaacatttaaagctgtgggatgaatgcacacatcacaaagtagtttctcagattgcttctgtggagattctatgtgaaggtgtttccttttctaccatcagcctcaaagcactcaaaatattcacttgcagattctacaaaaagagggtttccaaactgctcagtcaaaggaaggttcaactctgccgcaaagcgctcaaaatgtccacttgcagattttacaaaaagagtgtttccaaactgcacaatcacaagaaaggttcaactctgggagatgtatgcacacatccagataagtttctcagaatgtttctgtctagttcttatataaaggctgcagagcgctccaaatcccaatttgcagattctacaaaaaaagtgtttcctaatgctcaatcaaaagaaaggttcaactatttgagatgcacgcacacatcacaagctctttgacctaaagcagatggcaaaccacctcttgatatcagccctgatcagtgaccaagatgaagacatgctgagctacgtgatcaacttggaggtgaaagaagtgaaacatcccattcatctctgcaagatcatgttgttattttggagtaacccctacttccagaataaaatggtgaccaaggaatatcttgggaatgtcacaggtgacaagtggcttccaggatgggtagtggaaggaagatgatgggtggataattgccaatgtgatccagccctcttcacataaaatcctctctgtagaatacagggcttctcattccactccaattcagtagtatccagattatgaagttgagacttattgacccagacaccacaatagcagccttaacttcttcaactggttttctgaccacaacttcacaggacctaataggattgctgaggtgcatcctcaccgggaaacatcaggaatgacctggtgtgttcccagctgcttaggtcaccagtctgagccctgatgaggcctttcccaattgattcccctgacagatcctatgtaaggacctgtggcacaatcccctgcaatactacaagaggatgaagccacctgaagagggaacagagatttcaggggacttctggattttgagatgaatatgatggagcatcaggctttacctgaaacagcagaactcctacaaagttactacagtatgcaggatgtcagtactcagtatggtcttatgcacacgacctaaaggaaaaacagatccaggcacaaaaaaacgcagacaggaagaggggttaaacttggattttatggaatgaaaaataaacactattaaggatg

SEQ ID NO: 466808 - DNA, 1069 bp, Homo sapiens
cttagtgagcacgtgggtgtcacagttgccgtaatagtctcatacagggcacaaagctctccaaatgtccacttgcagattctatgaaaagagagtttcaaaaatgctcaagcaaaagaaacatttaaagctgtgggatgaatgcacacatcacaaagtagtttctcagattgcttctgtggagattctatgtgaaggtgtttccttttctaccatcagcctcaaagcactcaaaatattcacttgcagattctacaaaaagagggtttccaaactgctcagtcaaaggaaggttcaactctgccgcaaagcgctcaaaatgtccacttgcagattttacaaaaagagtgtttccaaactgcacaatcacaagaaaggttcaactctgggagatgtatgcacacatccagataagtttctcagaatgtttctgtctagttcttatataaaggctgcagagcgctccaaatcccaatttgcagattctacaaaaaaagtgtttcctaatgctcaatcaaaagaaaggttcaactatttgagatgcacgcacacatcacaagctctttgacctaaagcagatggcaaaccacctcttgatatcagccctgatcagtgaccaagatgaagacatgctgagctacgtgatcaacttggaggtgaaagaagtgaaacatcccattcatctctgcaagatcatgttgttattttggagtaacccctacttccagaataaaatggtgaccaaggaatatcttgggaatgtcacagatcctatgtaaggacctgtggcacaatcccctgcaatactacaagaggatgaagccacctgaagagggaacagagatttcaggggacttctggattttgagatgaatatgatggagcatcaggctttacctgaaacagcagaactcctacaaagttactacagtatgcaggatgtcagtactcagtatggtcttatgcacacgacctaaaggaaaaacagatccaggcacaaaaaaacgcagacaggaagaggggttaaacttggattttatggaatgaaaaataaacactattaaggatg

SEQ ID NO: 466809 - DNA, 1489 bp, Homo sapiens
tccgcgcggtgattcatcggcctggccgcgtcccccgcgcgggccatcttggtcacggccggcggcggacagagccgcggaggaaccgcgagaccccagggcccagagcaggtccagccacccgtctggctccgtagtccgcgaagtctgcagtaaaggagccgcgtgggaccggggccgaagtccctagggcctggcaccgcgtgcccctctctcgggccctcggcttgggggtctcgcagcgccctgccgtcgtgcaccccacactgcccccatttctacaggggcccacctggtcaccacaccctcttggtccacccgcggatctcagcgtgtggctgacctctggccagcatggtgcagccgcagacgtccaaagctgaaagcccagccttggcagcgtctccgaatgcccagatggatgacgttattgacaccctgacctccctgcgcctcaccaactcggcgctgaggcgggaggcttccaccctgcgggcggagaaggccaatctcaccaacatgctggagagcgtgatggcagagctgaccttgttacgcaccagggcgcggatcccgggggctctgcagatcaccccgcccatctcctcaattacttcaaacgggactcgacccatgaccacacctccaacctctctgcccgagcccttttccggggacccaggccggttggcggggttcctgatgcagatggacagattcatgatcttccaggcctcccgcttcccgggtgaggccgagcgtgtggccttccttgtgtctcgactgactggggaggcggagaagtgggctatcccccacatgcaacctgacagccccttgcgcaacaactatcaggggttcctggcagagttgcggagaacctacaagtctccgctccggcatgcgcggcgcgcccaaatcaggaagacttctgcctctaatagggctgtgcgagagaggcagatgctctgccgccagctggcctctgcgggcacggggccttgcccagtgcatccagcttccaacgggactagtccagcgccagccctgcctgcccgagcacggaatctttaagaatccgccagcacttggtagcgtctgcagccacccaggtagcatacgctctttgctgtgtagaagaaatgcccatacgacagctttgcccctgtttgaagacctcccttcttgcctctccagacgtgttccccgaggagatcttccttccgtccttcctggcgccctggttgcccaccttgccgtgcttcctcttacgtgctagctttgtacctatcgctcactgcatgctcgcctccctcttgctggcatcccggcctgtttcaatgactaccgctctgctacttaggcacagggactccgccgcacgctgacggaccacgagggctgaccccttccagcctgacttggttcatggaggctcctactctgccctctccaagctcccctggcggctccccacctggttgcccag

SEQ ID NO: 466810 - DNA, 1532 bp, Homo sapiens
  misc_feature (3)..(4): n is a, c, g, or t
  misc_feature (6)..(6): n is a, c, g, or t
  misc_feature (9)..(9): n is a, c, g, or t
  misc_feature (11)..(11): n is a, c, g, or t
  misc_feature (13)..(13): n is a, c, g, or t
  misc_feature (16)..(16): n is a, c, g, or t
agnnanaancncnatnagaaaaatgatgagactgaaaccagcctcattgtctgaggtgccacccgaagttgttgatgtcacggccaacgaaatcaaggactcggatactccaaagggagacttggctcacaccctcacaaggcaaagttctacaataggctgtctgcaagctagggaagaaggcagccagcagtggctcagtacaagtctgaaatcttcaaaagcagggaagttgacagtgcaaccttcggtctgtggccaaaggcttgagagccactggcaaaccactgttgtaagtccaagagtccaaaggccaaagatatcgaagacgtctgatatcgaagggcaggaggagtggaagggatatccagcaatggagaaagagtctcaggaagcaagtttatcccatctaccacctgctttgtttttgctgccctgatcagaatttcagatacggattagtcaattctttcccacaagccctaaaaaaaagctaaaatcaagcatttgcacatttaagataaacaagtatccctcttgtgctttgacactcttctttttcaaaaagacacagtcctttttaagggcttgattgattaggtgaggcccaccaggataatctttattttgattaattcctactcaactaattaggaacctaataatagggttgatatttaattgtattcacagatttcatatgtattcaaaaggaaggaattatataaaggatcatgaagtgagaatgtagtggaaatgcacattagaatcctgcttaccccagtatttaataatagtgattaaagtgtttatattataatatataataaataataatttatagaaattaatatattatttatttacttaataaacattcctagatgtgaaatggccgcatcaacaaagatgtatattctaatttggggagatattgccaaaatgctctgaaaagtggttttacttggttaatttcatgttgttaatacagaataccacatgcttatttacaaataaatttatttcacacagttctggaagctaagtctaatatcaaagtgattgcatctggtgagggccttcttccaaagtcatcccacagcagaagttgagagggtgacagaggaagagagacagaaagattgaactcacatcctcaagcccttttatcatcagcattaatttatttatgagagtgtagccttcatggcctaattatctctcaaaggtctcaccttttaatatattgttgcattgaagattaaattaaaagatgttttaattaaaaaattaaaccataattaaaccataattaaataaaattaaaccatataatgcttgatccaattaataatattatcacaaataataattgtagctcaccttaattgagtgcttattttgtgccaggcaggttcctaaaagctttacagattttctcatgcttaatgtttcaaatcttaaagttttagtatgagagtaagtgagaatctaattttaacttttgcatgtgatatggttaggctttatgt

SEQ ID NO: 466811 - DNA, 3586 bp, Homo sapiens
acaaactgtttctgaaagagtgttgtgagagttggatgttggcatgggtgtgtggctttgttttttttgtgtgtgtgtttgtgtgtgcctaatgaagaggagcacaccacaccaaaacaaaacaaaacaaaaaaaaaaaaaaagaaaaaaaaaaacaggcatctgccagtgtttcattgtcctgtggccaaccaagaaagagacactgtcagtcctgtcctcatggccccttgaatttaccaagaattcagttcactgccaagcaggttcttctggtcatgagacggcactcctccatcgtctgggcatttatcctgggacatacaggatgatgcttgatgtttcttggctttcatgggggattcacattgccactcaaccacactactggatacacttttcaggcttgccatcaccacagatggcctctgagacactgtttgaaccacatctgcacctgtgagaggccagtttgaggtatgagaacactgtttcaatttggacttgcctttgtcttggttcctgcttttcccagatagcacctacccaacccaggatgaatgagtgcagagaggtcaagtgccaggccatcttttgctgacacccttttctggtatttcaggtataagtccatcatccaaagactgctcaacatctcaccagaatatatttcaatcctcatggggcatgattctttcacaaaacccctttcaggaatggagtcagaagagtagtttccagagacaacctcacagtcttgaaacggctctgcctcccatgtgatctgaccatggagatggcatataagggccctaagtttgagacttttagggtactgcaatgcgttatcacaggcagcctttatcctgataccaagccagctctgcctgtaccattttcctctgcttaggcaggctgacagccctgacaccctggtgctccagtttgagtcactatatgtggatgtgctagtcttagggcaatggacctgagctgtgagctgtagctagtgtcacaatgaatgccagctttgctagtaacaattccctttggcttggtagagaaggagacctctgtggaggtacaatggtggtgcactgtcacctgtcttctctgtgggatccatgggacagttccatgatcctaggagagggtagatgtgagccagcctgaagaaatgtcaagcagagccccaggaatgaagcacaaaatcactacagatccaaaaggatctgcagaatttgtcaggcctgcctagacattgtaggggttagtcttattgaaatgtgtcccactgtaatttccaacttcagccttcctgtgttcccagcagtttctctctcccaggtggggctttctgcagaatgacacagcctcagaagctactgggctgtgtgttactgtgggagtgttgcgagtgttggatgtcagcatgtgtgtgtggctttgtgtgtttgtgtatgtgtctgtgtgtgtgtatgtaaatgaattctgtggatcaggaatcagcaatgactagttaagctgtctgtgaccagccgggttccccatcgtctgcccctgccaaaaaaacaggtactcttctacaaagaagaggagagcaccacacccaagaacagacatctcccagtgttgcattataaagcagccaacccacagacactagcactctggtctgcatagcccctttaatttacctagaattcagttcccagccaagtaggtgcttcatgtcctgagggtgcaatcctccatcatcttgagatttcatgctggtacagagagtgtgacagcaataaggtcagataggggtgagtatacaacctggtgaagggtggatggggtcccgtaccttcaccagcaaaaagggtgaaaatagatgacacagaatgtgcttccaactccatccccacattcccataattgcaaaatcagtcaacaacatggcctggtgtttaggtgggagtactccaacctgcaggaaaaatttggagtgcaaattgtggccaatctggaaaactcctggtttgagggttttaatacctgtagtcaaatggaagtggaatagattgatgctgggtgggttgtggcctccacatttgtgtcctcttttactgacttccattgtcctcattggtgtagggcttcctggatctggctcaacatcttccacactaaactcttccctgttcacagaagaccatcataaaaatgcattgtagaggccctgcaaggaccaggatgaagggagacagtgaggtcaagagcccagccatctttcactgacacccacttctgggttctcaggctggctgacaggtctgacagcccatcacgaaagcctgcatactcttagacacaaggactgagctatgggctccagctagcatcacaatgaaggccaccattgcctagggataagtccctgtgactttgtggataagaactccgtggagccaatccaaggagagacactatcattcatctctaccgggcctattaaatttacctcgaatttgattcccagaggagttggtgcttcacatcatcagggggaacttctccattgtcttgggatttcagtctgggatagagactttgaacagcaataagtttccttggtctggctcaacgtcttctaaactcaacattccccagttcatggaaaatgatcctcatgggattctattgtaaaagctgcatgattcctggagaatgttttattgtcctgaagtcaacccaaaaatcaacactaccagtcatgttgcagagctccttgaattaaccttgaattcagtttccagctgagcagctgcttcacgttgtgagggggcaatcctccatcatcctgggatttcattctgggacacagagtttgagcagcaataaggctgggtccacattgcccctcaacagcattagtggacatgattgtcagacttgcaatttccgcagacaccttctgtgaacatttttcaacatcatctacatgagtgagagacccgttcgacatgtaagaatactgcttgactttggacctgcctttgtcgtggttcctgcctttctcatagatcccctgccaggcccaggatgataggaggcaatgaagtcaagggccgagccccattcattgaaagctgactctggggtctcgggtataattccatcacataaaatcccctcaacaactcaccagactatattccaatctccatggaacctgattcttgcacacagcctctttcaggaatggagtcagaagagcagtcttcagagaccacctcagtttggaaaagcctcctccttcagtggttcccagccatggagtcatcgtgaaggggctccatggtcaataattttacggtactgcacttggttatcacagacagactttttcatgatagcatgccatctctgtctatatcattttcctctgcttaggcaggctgacaactctgacagccaggggcccgaatctacctggcaaatgtgcatgctctactctcagtgcaaaaggcctgtttgggagttctgactagtgtcacaataaatgccgccattgcctagtgacaagtccctgtggatt

SEQ ID NO: 466812 - DNA, 863 bp, Homo sapiens
agaggaagtcacatcgagaaacagcccagtgaatgagctcctccacaatgaaaaggctgtgcagatgaaatgaaacagaagctagattaccaggcaaaggccagacatggattctcatcctataggtattatgcagccattcgatagaagtgggagaaaaagagtttctttgttggcagtggtaatgggaattttcagttttaaaatatcaagcttcccagttattaaaacatgacactgtttagaaggaaacactcaggcaatggagtcccatgaagatcattctctgtgaactgggaaagcttaagtgtggaagttgttgaaccagtcacaggaaactctaggtggatgaggaacatagaagtcagaaaaagaagaaactgtggaggccacatcccacccagaatcaattcattccattgcattggtctccgaatatgaaagccctcaaatcgggagtttgccaggatggccccaatttgcaccccaaatgtccgttgcccgttgtagtattcccacctgaacaccatgccattgtgtatactgcttgtgcaattaagggaatgaggggatgaagttggaaacacgtgctttaaacactgtctttatttttattgcaggtgtagttacagggccccaaccacctttcaccagattgtatactcacctgtatctgaccttattgctactcacactctaggtcccaggataaaatcccaacatgatggaggagtgccccctcattatgtgaagcacctgctgggcttggaaccaaattcagtgtaagttcaagtggccctgtggagaggactgctagtgtctccccctgtatttgctgcaggaaaataaaacagtgaaaaatg

SEQ ID NO: 466813 - DNA, 1720 bp, Homo sapiens
gcgatagttcactgctgacgcacctctacagaagtctcattcaccaagctgaagagacttgttgctaggtaatggtgacatttatgctgatgcaagccagagttcacaatgaggcctggtgccctgaggatagtgcatgcacattccaacaacccaatgaaagagaccctccacaagaagaatgccatgcagatgaaatgaaacagaggctagattacaaggaaaaagacaaacacggctgcctgcttttcatcctgcaggaattatgcagcacctcgatagaaatgggagaacaagagttttcttattggtggctgaaaatatttgttgtggaagttgttgagccagacccagaacacaggcaagagttcaatgctaacgcacctccacgaaagtctccgtctctgccaagcctcagggacttctcagtatgcaacagtcacagtcattgtgatgctagcaaggtctcacaatcagtcctggtgccctgagcagttaccatgacaaggcaagtacaaggaggagcagtgtcctcacgcattggactggcctccaatgggtgtagttacagggccccaaccacctttcaccagattgtatactcacctgtatctgaccttattgctactcacactctaggtcccaggataaaatcccaacatgatggaggagtgccccctcattatgtgaagcacctgctgggcttggaaccaaattcagtgatgaaatcccaagatgatggaggagtgaaccctgacgacaggaagtacctgctcacctatgaacaaaatttgaggaatatggatgtatcctgtggatccctcagagaagacaggcaagagtccaccaccaaggcacctctatggaggtctccttcttggccacgcagccaggactgatctctatgtaatggtgacattcattgtgatgctagccagagctcatagtcaggcctggtgccctgaggcgtgcatgtgcatttgagggcatgcttgctggcctggctttcacagatgttagcctgtggaagcagaagaaaatggtacacatagagctggctcggtatccagaaataggctgcctgcaataatgcactgcgggaccctacaatgctcgaagttagggcgacttcaagccgtctccctggtcagctcctgcaggagtaggaggcattcagagactgaggtggtcgctgaaatctgttcttctgattcccttttggaaagaggctgtgtgcaagaatccagtcccatggggattggaatgtagtctggatcgtgggactatcctgtggatcccacagagaagagagaggacagtccaccactgatgcacctccacagaggtctccttctccgccaaacctcacggaattgtgacattcatggcgaatgtgcgggaccccatccatccctcaccagcttgtatcctcagctttatctgaagttaaaagtatctttcccataatgaaatccaaagatgatggaagagtgccccctcacggtgtggaggtcctgcttggctagcaactgaatatgaagtaaattcaagggaccctgcggaccggactgctagtgtttctaaatggggtgtacactggacaataaaacactgaaagatttctgttcctgaatttcctgtgctcctcttctttctagaagtgtggctttgtttgtttgtttgttttgtttttgtggggggaggttatttggaccatggc

SEQ ID NO: 466814 - DNA, 1880 bp, Homo sapiens
agaggaagtcacatcgagaaacagcccagtgaatgagctcctccacaatgaaaaggctgtgcagatgaaatgaaacagaagctagattaccaggcaaaggccagacatggattctcatcctataggtattatgcagccattcgatagaagtgggagaaaaagagtttctttgttggcagtggtaatgggaattttcagttttaaaatatcaagcttcccagttattaaaacatgacactgtttagaaggaaacactcaggcaatggagtcccatgaagatcattctctgtgaactgggaaagcttaagtgtggaagttgttgaaccagtcacaggaaactctaggtggatgaggaacatagaagtcagaaaaagaagaaactgtggaggccacatcccacccagaatcaattcattccattgcattggtctccgaatatgaaagccctcaaatcgggagtttgccaggatggccccaatttgcaccccaaatgtccgttgcccgttgtagtattcccacctgaacaccatgccattgtgtatactgcttgtgcaattaagggaatgaggggatgaagttggaaacacgtgctttaaacactgtctttatttttattgcaggtgtagttacagggccccaaccacctttcaccagattgtatactcacctgtatctgaccttattgctactcacactctaggtcccaggataaaatcccaacatgatggaggagtgccccctcattatgtgaagcacctgctgggcttggaaccaaattcagtgatgaaatcccaagatgatggaggagtgaaccctgacgacaggaagtacctgctcacctatgaacaaaatttgaggaatatggatgtatcctgtggatccctcagagaagacaggcaagagtccaccaccaaggcacctctatggaggtctccttcttggccacgcagccaggactgatctctatgtaatggtgacattcattgtgatgctagccagagctcatagtcaggcctggtgccctgaggcgtgcatgtgcatttgagggcatgcttgctggcctggctttcacagatgttagcctgtggaagcagaagaaaatggtacacatagagctggctcggtatccagaaataggctgcctgcaataatgcactgcgggaccctacaatgctcgaagttagggcgacttcaagccgtctccctggtcagctcctgcaggagtaggaggcattcagagactgaggtggtcgctgaaatctgttcttctgattcccttttggaaagaggctgtgtgcaagaatccagtcccatggggattggaatgtagtctggcacccttcagatccttttggaaccttacggatttcgcggtttattcctggggtttgcttgacgtatcttccagctggctcttgtctgctctcccctaggatcgtgggactatcctgtggatcccacagagaagagagaggacagtccaccactgatgcacctccacagaggtctccttctccgccaaacctcacggaattgtgacattcatggcgaatgtgcgggaccccatccatccctcaccagcttgtatcctcagctttatctgaagttaaaagtatctttcccataatgaaatccaaagatgatggaagagtgccccctcacggtgtggaggtcctgcttggctagcaactgaatatgaagtaaattcaagggaccctgcggaccggactgctagtgtttctaaatggggtgtacactggacaataaaacactgaaagatttctgttcctgaatttcctgtgctcctcttctttctagaagtgtggctttgtttgtttgtttgttttgtttttgtggggggaggttatttggaccatggc

SEQ ID NO: 466815 - DNA, 1976 bp, Homo sapiens
gcgatagttcactgctgacgcacctctacagaagtctcattcaccaagctgaagagacttgttgctaggtaatggtgacatttatgctgatgcaagccagagttcacaatgaggcctggtgccctgaggatagtgcatgcacattccaacaacccaatgaaagagaccctccacaagaagaatgccatgcagatgaaatgaaacagaggctagattacaaggaaaaagacaaacacggctgcctgcttttcatcctgcaggaattatgcagcacctcgatagaaatgggagaacaagagttttcttattggtggctgaaaatatttgttgtggaagttgttgagccagacccagaacacaggcaagagttcaatgctaacgcacctccacgaaagtctccgtctctgccaagcctcagggacttctcagtatgcaacagtcacagtcattgtgatgctagcaaggtctcacaatcagtcctggtgccctgagcagttaccatgacaaggcaagtacaaggaggagcagtgtcctcacgcattggactggcctccaatgggtgtagttacagggccccaaccacctttcaccagattgtatactcacctgtatctgaccttattgctactcacactctaggtcccaggataaaatcccaacatgatggaggagtgccccctcattatgtgaagcacctgctgggcttggaaccaaattcagtgatgaaatcccaagatgatggaggagtgaaccctgacgacaggaagtacctgctcacctatgaacaaaatttgaggaatatggatgtatcctgtggatccctcagagaagacaggcaagagtccaccaccaaggcacctctatggaggtctccttcttggccacgcagccaggactgatctctatgtaatggtgacattcattgtgatgctagccagagctcatagtcaggcctggtgccctgaggcgtgcatgtgcatttgagggcatgcttgctggcctggctttcacagatgttagcctgtggaagcagaagaaaatggtacacatagagctggctcggtatccagaaataggctgcctgcaataatgcactgcgggaccctacaatgctcgaagttagggcgacttcaagccgtctccctggtcagctcctgcaggagtaggaggcattcagagactgaggtggtcgctgaaatctgttcttctgattcccttttggaaagaggctgtgtgcaagaatccagtcccatggggattggaatgtagtctggatcgtgggactatcctgtggatcccacagagaagagagaggacagtccaccactgatgcacctccacagaggtctccttctccgccaaacctcacggaattgtgacattcatggtatcaagcagctgtctgataaaagctggataagaagagtttccttcttggctactgttacagaaatttatggttttaaaacaatcaaagttgcccagtcattaaaacccaatagtatttagaagaaaacactcatgaaatggattcccttgagggtcgtcttccattaagtggtaaacatttaatgtggaatatgtacagccagacccaagaaaccttaggctgatgaggtacatggatgtcaggaaaataagaggcgaatgtgcgggaccccatccatccctcaccagcttgtatcctcagctttatctgaagttaaaagtatctttcccataatgaaatccaaagatgatggaagagtgccccctcacggtgtggaggtcctgcttggctagcaactgaatatgaagtaaattcaagggaccctgcggaccggactgctagtgtttctaaatggggtgtacactggacaataaaacactgaaagatttctgttcctgaatttcctgtgctcctcttctttctagaagtgtggctttgtttgtttgtttgttttgtttttgtggggggaggttatttggaccatggc

SEQ ID NO: 466816 - DNA, 822 bp, Homo sapiens
catatacaagtaaacatttattaacagtaaaatattatttttatttttgcatattctcaaatacacatttacaatagtatcacacttcctatatgaattcttcatagttattttaagtattttacaatttgtacagaggaagggacatacaatatctaataggctatttttcaaccaaataataatttatgtccttgtaagattttgtacctctttaaaactttcaacttcaacatccacttttttagctttgctaatcaaattaagaattaaaaccagcctgcaaataataacagtatataacattaagcacaatttcatttctttctttatacaaatgttctatatttacttgaccaaatgcttaattaccttttaaaggtttcaataccgtggttaaaaacaaaacaactgtgtatacctccagactatatgaaaaatatgaaatatgtaaagtgtcacgttttttaccttagtttatttttaaaagataaatagctaactatctgtattaattttaaagaatgttttaaaactcttaaactttcacttaaatacttccttttatattacttcagggagaaaacaaattggaaggagatttaaaggattctcaaatacaaactgaagttttcaagaacaggatcatgaaggacagtaaaaatcaggtagggacatgtataaaggctaagaaggcctaacagattcttaaaatccattacatggttttggatggtactaggtttaaattcatatatgactaaagcactttagaactagatcaaattaatctaacatttcagaggctgccaatcaccaaat

SEQ ID NO: 466817 - DNA, 859 bp, Homo sapiens
aagttgtcctgatagcatgcctggagtcacgggtctcccccaggctggggccccagacccacaggcaaaggagacagcaaacctgtcgtcttcactcctggctggctcaccaaaatgtggctggaatcaggagaccggagagaccaatgaggggaacaggacgattgtatttaggtggccaccagctcagcagattaatacccagaggctgagcaatgagcaaagaaagggcttgacttttattcatgtgaccaaaggatgggaaaaacaggaccttacaaaatccttgcaaacttgcagaaatagttacaaaaatagttatacaagcagaacaaagaatgatggcatgggtagagaatttcaggaagacactgataagaacttgtttctcttgtccctgtttttggaacccatttcttcagggcccctacctggccttgcaggtaatgttatcacagctgtagctggactttggagtgagtcagcctggtcagggaaggacttgtttttctttttacttgtttttcttatatttcctgcttcatgagcaagaaacaacaagctttaccttcacagtagaagagtccagcagaacaaagttggaagcagagggagtgaatctaaacctatggacagattcatcttggaaaccctaagtgaggctaaagggagaaaacaaattggaaggagatttaaaggattctcaaatacaaactgaagttttcaagaacaggatcatgaaggacagtaaaaatcaggaattgccaaactttgtcacaatggctgtacaacatcagtgagccgaagtcataccactgcattacagcccgggcgacagagaaagactccatctcaaaaa

SEQ ID NO: 466818 - DNA, 1156 bp, Homo sapiens
aagttgtcctgatagcatgcctggagtcacgggtctcccccaggctggggccccagacccacaggcaaaggagacagcaaacctgtcgtcttcactcctggctggctcaccaaaatgtggctggaatcaggagaccggagagaccaatgaggggaacaggacgattgtatttaggtggccaccagctcagcagattaatacccagaggctgagcaatgagcaaagaaagggcttgacttttattcatgtgaccaaaggatgggaaaaacaggaccttacaaaatccttgcaaacttgcagaaatagttacaaaaatagttatacaagcagaacaaagaatgatggcatgggtagagaatttcaggaagacactgataagaacttgtttctcttgtccctgtttttggaacccatttcttcagggcccctacctggccttgcagaagagtccagcagaacaaagttggaagcagagggagtgaatctaaacctatggacagattcatcttggaaaccctaagtgaggctaaagtcctgtcaaccatcatctacatactgtctccctgaatttgactattccagggacttcatatagacagaatcatgctgtatttgttcttttatgtctggcttattttacttaacactgtttttactgtaagtccagttgtagcatatgtcagaattgtattctattttaaggctgaataacattccattttaagtatatttcatattttgtttatccgttcatctcttaatggaaatgtgaattgtttccaccttttgcagttgtgcatactcttgccataaatatttatgtccaaatatctgtgagccaggctttcaattatttggggtatatatgtaatcttggaattgctgaatcattttccacatcagctgcaccattttgtactttcactagcaattcataatatccattttctccacatttttcccaacacttatttgctcttaaaaaatttctgtgtactatttaccaatgatctaaaacgcaacatattgtagtgtaaacctaaaaaaacaaacacagagactctttaaaagaaaaggtgtttatttggaaaaggaaaattgcaagcaatgcacaagctatagtaaactaggtgcacattcagagcagtaaaggaag

SEQ ID NO: 466819 - DNA, 1370 bp, Homo sapiens
aagttcatgtccttttcagggacatgaatggagctggaaacaattattctcagcaagctaacacaggaacagaaaagcaaacactacctattctcatgcataagtgggaatggaacaatgaggacacaatggggcctgagagcatgcccaaggccttggggacccttggaccctggaagaagggcggaagtggggtaggtgggggcggtatttggagccactgcccctctggcagccactgctgctccccatggatggcttggagtctcagccttcagcagaatcagcaggctttccgcaaacagctaccaccagagggtgcacggagcctacgcactgagcatgcagagcccgcaaacaaactctctgaggagcagggtgtcctcacagtgcctcggatagcacttccttctcctcaagacacaccggagagaggccgtggtttcagggtacctggggacacctgaggcacgttcgtagtgaagactaagcctccttcatctcaggacccgcccaagagtggccgcagctttggcccacctggggtcgcgtccaccatgaagatgaagtctctttctcttctggacatgtccaggagtggccgttgctacaagacatctggtgctacgaccagaaagactacaacaaacgcaataaattagcacacaagtgcttcttcactcctcccagaattaggaaccagggcctgaaatggaaaatgcagatttcaatttcgaagccttcatctgtgcctgggagaatgaaatctcacactatctctttggctggagtgcagtggtgcaatcgtaggacactgcaaccccctgcctcccaggttcaagtatttattcttcctcagcttcttgaatagctgagaatacagatgcacaccaccacacctgatggatttttagcatattggccacacttgtctcaagctccagacctcaagtactctgcctgccttggcctccaaaagtactggaattacatgtgtgaatcaccatgcttggcccctgattgaaattctaattcaaaaaaatccctcttgcaaaaccttattttctatattatatttttgatgagtttctttatatgtctcataattaaagcaaatggtatcattttaatgtattttcttatacttgaaaatgaatttatttttattaatctgtaattaaaatagtaggtatatttagaatgttaatttgctgtgtgtaaacatgattagaaatttctttaaaaaactaatttggataattaattacattagttgattgtacttgtgttattttcctcaggattttcttttcttttcttttattattattataatttaagctttagggtacatgtgcacattgtgcagg

SEQ ID NO: 466820 - DNA, 1040 bp, Homo sapiens
cggacgcgtgggtcgacccacgcgtccgcaaactctctgaggagcagggtgtcctcacagtgcctcggatagcacttccttctcctcaagacacaccggagagaggccgtggtttcagggtacctggggacacctgaggcacgttcgtagtgaagactaagcctccttcatctcaggacccgcccaagagtggccgcagctttggcccacctggggtcgcgtccaccatgaagatgaagtctctttctcttctggacatgtccaggagtggccgttgctacaagacatctggtgctacgaccagaaagactacaacaaacgcaataaattagcacacaagtgcttcttcactcctcccagaattaggaaccagggcctgaaatggaaaatgcagatttcaatttcgaagccttcatctgtgcctgggagaatgaaatctcacactatctctttggctggagtgcagtggtgcaatcgtaggacactgcaaccccctgcctcccaggttcaagtatttattcttcctcagcttcttgaatagctgagaatacagatgcacaccaccacacctgatggatttttagcatattggccacacttgtctcaagctccagacctcaagtactctgcctgccttggcctccaaaagtactggaattacatgtgtgaatcaccatgcttggcccctgattgaaattctaattcaaaaaaatccctcttgcaaaaccttattttctatattatatttttgatgagtttctttatatgtctcataattaaagcaaatggtatcattttaatgtattttcttatacttgaaaatgaatttatttttattaatctgtaattaaaatagtaggtatatttagaatgttaatttgctgtgtgtaaacatgattagaaatttctttaaaaaactaatttggataattaattacattagttgattgtacttgtgttattttcctcaggattttcttttcttttcttttattattattataatttaagctttagggtacatgtgcacattgtgcagg

SEQ ID NO: 466821 - DNA, 3692 bp, Homo sapiens
actgcagaagtgggtacaggacaggtcaggtcatggctcaaagtcagttccccagaggccaaggcaaggttctttcccatgatgtcccactgtggcacccatctcaggaatcctgccagaacgtgggcagtcatggtcagccaaccgaccgtagaagctcaggtgtgtccagaattggtgggttcttggtctcactgacttcaagaatgaagccgcggaccctcacgtggcttcgtggtctcgctggctcaggagtgaagctgcagaccttcgcggtgagtgttacagctcataaaagcaagtgtggacccaaagaatttattgcaaagaatgaaagaacaaagctgccacagtgtggaaagggacctgagggggttgccaatgctggctcgggcagcctgcttttattctcttatctgacccaacccacatcctgctgattggtagagccgaggggtgtgttttgacagagcactgattggtgcgtttacaatccctgagctagatacaaaagttctccatgtccccatcagattagttagatacagagtatggacacaaaggttctccaaggccccaccagagcagctagatacagagtgtcagttggtgcactcacaaaccctgagctagacacagggtgctgattggtgtgtgtacaaaccttgagttagatacagagtgccgattggtgtatttacaatccctgagctatatataaaggttctccatgtccccaccagactcaggagactagctggcttcacccagtggatcgcgcactggggctgcaggtggagctgcctaccagtcccacgccatgcgcttgcactcctcagaccttgggtggtcgatgagactgggcgccgtggagtagggggcggcgctcctgagggaggctcgggccgcacaggagcccacggagggggtggggggctcaggcatggagggctgcagttacggacccctgccccgcggaaaggcagctaaggcccggcgagaaattgagcacagcgccggtgggctggtactgctggaggacccagtacaccctccgcagccactggcccgggtgctaagcccctcattgcacgcggctggcagggccggcaggctgctctgagggcagggcccgccaagcccacgcccacctggaactccagctggcccgcaagcgccgcgcgcagcccgggttcccactcgcgcctctccctccatacctccctgcaagctgagggagccggctacggccttggccagcccagaaaggggctcccacagtgcagtggtgggccgaagggcttctcaagtgccgccaaagtgggagcccaggcagaggaggcacggagagcgagcgagggctgtgaggactgccagcacgctgtcacctctcacagggaaacaccctgcaactttgcaagagcacggagagtgtggggcagggctaccccgcaggcctttggtctggcaccctcccttcctggtcctctgtctggtgttggcgggcaccttcgcagctgtggtggtcttggcggcgggtggaggcaggccaagacagcctgctctgaccagggacaggcacagaaaaagtggggaggggattgccggcggggtgttgtggtgtgaggcagctacttgctcagggttcctgagctgtgggaggccctcatgtgctgggtgctggacaggctctgctgctgtccgtgtgtgcggtgtcctcttctcttggtctcactgaggggtgggcgtgtccacccgagggaaccgctgtgaatagaagtagctgcagggctgtgcctgactctctccatgagactctagtggtttcatgggaggttgtatatgctcatggcctaaacatccttggatgcagcactggcagagggaagaaatcgtgtctgaggagctggtgcctgccttgcagaggacagcagccccgtgcacggtgaacccgagtattgagcaccttgtgtttctaggataagcctgctggacacaggtaccgggagcaggggtatttccatggctggcctgggcgcgcagattccccttcctccagggattttcccagtgaaatgtgtccttcaactttctgctgtttatgaagggtcctttgaggtgctattctcccttgtgagtgctgtgcttggctttctgtccctataacgtgccctcagggtgcccgcaattaagctgcccttctatctgcatgaatctgtccttggttcccctcgttgtcccccatgtcctgaatcctggctgagccccggtgcctaccaccttgtttcccccaaccccgctcctgggagctcggcgcccacccacctgtcagccatcccgaattggcagctgcaaggatatggctctgacccagaagccgtggatgccctgcggcctgggacattcactggagcccagctccaagtgaaggacgtccagcgagttggttgctggccggggcgtcctggggccagggccaggctgtgcctgcgggtcctcctgctgccgctccacattggcctcctccttggccaccacctctatctctgccatgatgtcatcccccactagccactagcatgcctcctcccccagggttgcctccctgctctgcgcacaggctgccctttcctgcagcacctcccccttaacatggtgccctccttgaggctcccacagactaaggcctacactgcccatctcatgtccttggcacccctagactctagaggaagctcccggaagggcccctgggccttgcccttctgagaaacatgtgccacacccacgtggatacagggttcctggggagccccgcagggcccacagtccgccacactcaccatggggcccagatacccagcagggttagctgtacacagtagccctggagtcggaggccgaggccctgggcttccagagcctcactggcaggcacgacggccactgcggcgcttgcgggaggatctgtgccagcgaggcagtgcacacgggttatcgcattggcaaccatggcggctggcctcccgtgtgcccaggggcacaggatgagaggtcctttggaacgcccctcttatttatttttatctaaatatagatttttctttgaccatttgcagcacaatggtagaagcagatcatccgggcaagcttttcattggtggcctcaatagggaaaccaatgaaaagatgcttaaagcagtatttgagaaacatggtcccatatcagaagttcttttgataaaggatcgaaccagcaaatccagaggctttgcatttattacttttgagaaccctgcagatgttaagaatgctgccaaagatatgaatggagagaaatcatccaagctcccaagaaaccagggattatgctccaccatctagaggctatgcatactgtgataatggtcactctagtcgggatgaacattcctctagaggatatagtgatagtggtggctacgacgaaacccgtggtagagatcattctgatcgtacaagtggaagttcttacaaaaatgaatttcagggatatgggacctctcatggtgcaccacctgcaagagggcctcggatgtcttatggtggaagcagccaccctgattataacaatacacgagatacatagggcagaagtcaagaaagttactcaagaagctgcggtgatttttacttttgtggtcatgagcaca

SEQ ID NO: 466822 - DNA, 1076 bp, Homo sapiens
acatcacacactagggctggtctgaggtttcatcctctggctccttgctttcctccataaaacccatctaaaatgaccttctgggctactgactgctcactatccctgcgtgtcaactctttagctgtgcacaattatgcaagaacagccctcctcacttccctgaaaagacctgaatgaagccagggtctcaggtttgaggtcatagatctggttctggaggacagaagttgaagatcagaatgccagcatggtcgagctctaggagctatgaaatatctgagatgagcaagtgattcacaaggagacagaagcagtatgacctttaccctgtgacccggttcaattatttcaggctctcattaaccaggcgagctcctctttctctcagagctgcaaacaaggaaactgaatgtcacaccaggtggccagcatttctgtgaagggcagaaaccggggcagccaaacagctggcagaggccagctagacaaagactcccttttcttacagctggaatgaggggtggggagatttcatggtgtcctgtacaggttggatgttaatctgatgtggtgctcttggagaagcttgcctgagtcaggtgctttctcatcctgtggtgtgtgcttccccttcaagctgcagaagtccctgaagaggccctgcgtggctgctgtggctgccctgagactcgttctgcctcctcttccctccacagctctcccagcttctacccacagctgtgctccaggtaaacaaccaggggcctccaggggtagagaacctagccagacaggttctgctgcctgtagacttgatgtccttcccccacaacatgccatgcttgccaggctggaagggggtctccagatacttgggaaatctgggcctgtaattgggaaatacatgggtaccaagcctaatccacattcagacccgatgggaactgcagcagggactcgccctctgtgcaactctgggtgtaccacttcagaaggaccatctgatcccatgtgtcattggagatactacatgtgggcaggttccagtggttgcttcagctgaaccttcccaa

SEQ ID NO: 466823 - DNA, 1952 bp, Homo sapiens
ttattccagtgacataacgccatggtgtttgccaacaggaccctggtggtgaaatcaatgacagacaaagacgccggagattacctgtgtgtagctcgaaataaggttggtgatgactgcgtggtgctcaaggtggatgtgatgatgaaaccggccaagattgaacacaaggaggagaacgaccacaaagtcttctacaggggtgacctgaaagtggactgtgtggccactggacttcccaatcccgagatctcctggagcctcctggatgggagtctggtgaactccttcatgcagtcagatgacagtggtggacgcaccaagcactatgtggtcttcaacaatgggacactctacttcagtgaagtggggatgagggaggaaggagactacacctgctttgctgaaaatcaggttgggaaggatgagatgagagtcagagtcaagatggtgacacctgccaccatctggaacaagacttacttggcagttcaggtaccctatggagatgtggtcactgtaacctgtgaggccaaaggagaacccatgcccaaggtgacttggttgtccccagccaacagggtgatccccacctcctctgagaagtatcagatataccaatatggcactctccttattcagaaagcccagtgctctgacagcggcaactacacctgcctggtcaggaacagtgccggagaggataggaagacagtgtggattcacgtcaacctccagccacccaagatcaatggtaaccccaaccccatcaccaccgtgtgggagatagcagccgggggcagtcggaaactgattgactgcaaagctgaaggcatccccaccccgagggtgttatgggcttttcccgagggtgtggttctgccagatccatactatggaaaccggatcactgtccatggcaacggttccctggacatcaggagtttgaggaagagcgactccgtccagctggtatgcatggcacgcaacgagggaggggaggcgaggttgatcgtgcagctcactgtcctggagcccatggagaaacccatcttccacgacccgatcagcgagaagatcacggccatggcgggccacaccatcagcctcaactgctctgccgcggggaccctgacacccagcctggtgtgggtccttcccaatggcaccgatctgcagagtggacagcagctgcagcgcttctaccacaaggctgacggcatgctacacattagcggtctctcctcggtggacgccggggcctaccgctgcgtggcccgcaatgccgcgggccacacggagaggctggtctccctgaaggtgggactgaagccagaagcaaacaagcagtatcataacctggtcagcatcatcaatggtgagaccctgaagctcccctgcacccctcctgcagctgggcagggacatttctcctggacactccccaatggcatgcatctggagggcccccaaaccctgggacgcgtttctcttctggacaatggcaccctcacggttcgtgaggcctcggtgtttgacaggggtacctatgtatgcaggatggagacggcgtacggcccttcggtcaccagcatccccgtgattgtgatcgcctatcctccccggatcaccagcgagcctaccccagtcatctacacccgtcccgggaacaccgtgaaactgaactgcatggctatggggattcccaaaggtgacatcacgtgggagttaccggataagttgcatctgaaggcaggggttcaggctcgtctgtatggaaacagatttcttcacccccagggatcactgaccatccagcaggccagacggagagacgctggcttctacaagtgcacggcaaaaaacattctcagcagtgactccaaaacaacttatatccatgtcttctgaaatgtggattccagaatgattgctcaggaactgacaacaaa

SEQ ID NO: 466824 - DNA, 1237 bp, Homo sapiens
ttattccagtgacataacgccatggtgtttgccaacaggaccctggtggtgaaatcaatgacagacaaagacgccggagattacctgtgtgtagctcgaaataaggttggtgatgactgcgtggtgctcaaggtggatgtgatgatgaaaccggccaagattgaacacaaggaggagaacgaccacaaagtcttctacaggggtgacctgaaagtggactgtgtggccactggacttcccaatcccgagatctcctggagcctcctggatgggagtctggtgaactccttcatgcagtcagatgacagtggtggacgcaccaagcactatgtggtcttcaacaatgggacactctacttcagtgaagtggggatgagggaggaaggagactacacctgctttgctgaaaatcaggttgggaaggatgagatgagagtcagagtcaagatggtgacacctgccaccatctggaacaagacttacttggcagttcaggtaccctatggagatgtggtcactgtaacctgtgaggccaaaggagaacccatgcccaaggtgacttggttgtccccagccaacagggtgatccccacctcctctgagaagtatcagatataccaatatggcactctccttattcagaaagcccagtgctctgacagcggcaactacacctgcctggtcaggaacagtgccggagaggataggaagacagtgtggattcacgtcaacctccagccacccaagatcaatggtaaccccaaccccatcaccaccgtgtgggagatagcagccgggggcagtcggaaactgattgactgcaaagctgaaggcatccccaccccgagggtgttatgggcttttcccgagggtgtggttctgccagatccatactatggaaaccggatcactgtccatggcaacggttccctggacatcaggagtttgaggaagagcgactccgtccagctggtatgcatggcacgcaacgagggaggggaggcgaggtgggcggatcacgaggtcaggagatcgagaccatcctggctaacatggtgaaaccccgtctctactaaaaatataaaaaattagccaggcgtggtagcgggcgcctgtagtcccagctactcgggaggctgaggcaggagaatggcgtgaacccgggaggcggagcttgcagtgagccgagatcacgccactgcactccagcctgggcgacagagcgagactccgtctc

SEQ ID NO: 466825 - DNA, 8337 bp, Homo sapiens
  misc_feature (1530)..(1530): n is a, c, g, or t
  misc_feature (1534)..(1534): n is a, c, g, or t
  misc_feature (1536)..(1536): n is a, c, g, or t
  misc_feature (1538)..(1538): n is a, c, g, or t
  misc_feature (1540)..(1540): n is a, c, g, or t
  misc_feature (1542)..(1543): n is a, c, g, or t
  misc_feature (1548)..(1549): n is a, c, g, or t
tggtgttgctcacttcaaaaatgaagctgcagaccttagtgatgtgtccagagtgtcttccttctggcaggttcatgttcttgttcacttcactaatgaagctgcaaaccttactggttcgtggtcttgctcacttccttaatgaagctgcagaccttactgatgtgtccagtgtttcttccttctggcaggttcatggtcttgctcacttcaagaatgaagctgcaggccttactgatgtgtccagagtttcttctttctgggagtttcgtggtcttcctcacttcaagaatgaagctgcagaccttactgatatgtccagcgtttcttccttctggcaggttcatggtcttgctcatttcaagaatgaagctgcagacttttacgatgtgtccagagtttctttcttctggcaggttcatggtgttgctcacttcaagaatgaagctgcagaccttactgatgtgtccagagattcttccttctggcagtttcctggtcttcctcacttcaagaatgaagctgcagactttactgatgtgtccagggtttctgtcttctggcaggttcatggtcttgctcaattcaagaatgaagctgccgatattagtgatgtgtccagagttacatccttctggcaggttcatggtgttgctcacttcaagaatcaagctgcagaccttactgatgtttccagagtttcttccttctggcaggttcgtggtcttgctcacttctttaatgaagctgcagaccttactgatgtgtccagagtgtcttccttctggcaggttcgtggtcttgctcacttcactaatgaagctgcagaccttactgatgtgtccagcgtttcttccttctggcaggttcatggtcttcctcacttcaagaatgaagctgcagaccttactggtccagagtttgtttcttcagatgtgtccagagtttcttccttctggcagtttcgtggtcttcctcacttcaagaatgaagctgcagaccttactggtgagtgttacagcactttaaggtgttatgtccagagtttgttccttcagatgtgtccagagtgtcttccttctggcaggttcatggtcttgctcacttcactaatgaagctgcagaccttactggttcatggacttcctcacttcaagaatgaagctgccgaccttagtgatgtgtccagcgtttcttccttctggcaggttcatggtcttcctcacttcaagaatgaagctgcagaccttactgatgtttccagagtttcttccttctggcaggttcgtggtgttgctcacttctttaatgaagctacagaccttactgatgtgtccagagtttcttccttctggcagtttcgtggtcttcctcacttcaagaatgaagctgcagaccttactggtgagtgttacagcactttaaggtgttatgtccagagtttcttccttcagatgtgtccagagtgtcttccttctggcaggttcatggtcttactcacttcaagaatgaagctgcagaccttactgntgangntncngnncttanngatgtttccagagtttcttccttctggcaggttcgtggtcttgctcacatctttaatgaagctgcagaccttactgatgtgtccagagtttcttccttctggcagtttcgtggtcttcctcacttcaagaatgaagccgcagaccttagtgttgagtgttacagcacagtgtcttccttctggcaggttcatggtcttgctcacttcaagaatgaagctgcagaccttactgatgtgtccagaatttcttccttccggcagtttcgtggtcttcctcacttcaagaatgaagctgcagaccttagtgttgagtgtgtgtccagggtttctgtcttctggcaggttcatcgtcttgctcacttcaagaatgaagctgccgacctttgtgatgtgtccagagtttcttccttcttggaggttcgtggtcttgttcacttccttaatgaagctgcagaccttaccgatgtgtccagagtgtcttccttctggcagcttcatggtcttgctcacttcactaatgaagctgcagaccttactgatgtgtccagaggttcttccttctggcaggttcatggtgttgctcacttcaagaatgaagctgcagaccttagtgatgattccagagtttcttccttcttgcaggttcgtggtcttgctcacttccttaatgaagctgcagaccttactgatgtgtccagagtttcttctttctggcagtttcgtggtcttcctcacttcaagaatgaagctgcagaccttactgatgtgtccagggtttctatcttctggcaggttcatggtgttgctcacttcaagaatgaatctgccgaccttagtgatatgtccagcgtttcttccttctggcaggttcatggtcttgctcatttcaagaatgaagctgcagacttttacgatgtgtccagagtttctttcttctggcaggttcatggtgttgctcacttcaagaatgaagctgcagaccttactgatgtgtccagagattcttccttctggcagtttcctggtcttcctcacttcaagaatgaagctgccgaccttagtgatgtttccagagtttcttccttctggcaggttcgtggtcttgctcacatctttaatgaagctgcagaccttactgatgtgtccagagtttcttccttcttgcagtttcgtggtcttcctcacttcaagaatgaagctgcagaccttactggtcatggtcttgcctcatccaagaatgaagctgcagaccttactgatgtgtccagagtttcttccttcttgcaggttcgtggtcttgctcacttccttaatgaagctgcagaccttactgatgtgtccagagttttttccttctggcaggttcgtggtcttgctcacttccttaatgaagctgcagaccttactgatgtgtccagagtttcttccttcttgcaggttcgtggtcttgctcacttccttaatgaagctgcagaccttaatgatgtgtccagagtttcttccttctggcatgttcatggtgttgctcacttcaagaatgaagctgcagactttagtgttgagtgttacagcacttataggtgttatgtccagtgtttgttccttcagatgtgcccagagtttcttccttcttgcaggttcgtgttcttgctcacttccttaatgaagctgcagaccttactggttcgtgttcttgctcacttctttaatgaagctgcagaacttactgatgtgtccagagtttcttccttctggcagtttcgtggtcttcctcacttcaagaatgaagctgcagaccttagtgatgtttccagagtttcttccttctggcaggttcgtggtcttgctcacttctttaatgaagctgcagaccttactgatgtgtccagggtttctgtcttctggcaggttcatggtcttcctcacttcaagaatgaagctgccgaccttagtgatgtttccagagtttcttccttctggcaggttcgtggtcttgctcacatctttaatgaagctgcagaccttactgatgtgtccagagtttcttccttctggcagtttcgtggtcttcctcacttcaagaatgaagccgcagaccttagtgttgagtgttacagcacagtgtcttccttctggcaggttcatggtcttgctcacttcaagaatgaagctgcagaccttactgatgtgtccagaatttcttccttccggcagtttcgtggtcttcctcacttcaagaatgaagctgcagaccttagtgttgagtgtgtgtccagggtttctgtcttctggcaggttcatcgtcttgctcacttcaagaatgaagctgccgacctttgtgatgtgtccagagtttcttccttctggcaggttcctggtcttgctcacttctttaatgaagctgcagaccttactgatgtgtccagagtttcttccttctggcagtttcgtggtcttcctcacttcaagaatgaagctgcagaccttagtgttgagtgttatagcaccaggttcatggtcttcctcacttcaagaatgaagctgcagaccttactggttcgtggtgttgctcacttctttaatgaagctgcagaccttactgatgtgtccagagtttcttccttctggcagtttcgtggtcttcctcacttcaagaatgaagctgcagaccttactgatgtgtccagggtttctgtcttctggcaggttcatggtcttgctcacttcaagaatgaagctgcagactttagtgatgtgtccagagttgcttccttctggcaggttcgtggtcttgctcacttccttaatgaagctgcagaccttactgatgtgtccagtgtttcttccttctggcaggttcatggtgttgctcacttgaagaatgaagctgcagaccttcctgatgtttccagagtttcttccttcttgcaggttcgtggtcttgctcacttccttaatgaagctgcagaccttaatgatgtgtccagtgtttcttccttctggcaggttcatggtcttgctcacttcaagaatgaagctgcagaccttactgatgtgtccagagtttcttccttctggcagtttcgtggtcttcctcacttcaagaatgaagctgcagaccttagtgttgagtgttacagcacagtgtctttcttctggcaggttcatggtcttgctcacttcaagaatgaagctgcagaccttactgatgtgtccagggtttctgtcttctggcaggttcatggtcttgctcacttccagaatgaagctgcagactttagtgatgtgtccagagtttcttccttctggcaggttcgtggtcttgctcacttccttaatgaagctgcagaccttactgatgtgtccagtgtttcttccttctggcaggttcatggtgttgctcacttcaagaatgaagctgcagaccttactgatgtgtccagagtttcttccttcttgcaggttcgtggtcttgctcacttccttaatgaagctgtagaccttaatggtgagtgttacagcacttcaaggtgttatgtccagagttttttccttcagatgtgtcctgagtgtcttccttctggcaggttcatggtcttgctcacttcactaacgaagctgcagaccttactggttcgtggtctggctcacttccttaatgaagctgcagaccttaatgatgtgtccagggtttctgtcttctggcaggtacatggtcttgctcacttcaagaatgaagctgccgaacttagtgatgtgtccagagtttcttccttcttgcaggttcgtggtcttgctcacttccttaatgaagctgcagaccttactgatgtgtccagtgtttcttccttctggcaggttcatggtcttgctcacttcaagaatgaagctgcaggccttactgatgtgtccagagtttcttctttctgggagtttcgtggtcttcctcacttcaagaatgaagctgcagaccttactgatatgtccagcgtttcttccttctggcaggttcatggtcttgctcatttcaagaatgaagctgcagacttttacgatgtgtccagagattcttccttctggcagtttcctggtcttcctcacttcaagaatgaagctgcagactttactgatgtgtccagagtgtcttcattctggcatgttcacggtcttgctcacttcactaatgaagctgcagaccttactgatgtgtccagagtttattccttcttgcaggttcgtggtcttgctcacttccttaatgaagctgcagaccttaccgatgtgtccagggtttgtgtcttctggcaggttcatggtcttgctcacttcaagaatgaagctgccgaccttagtgagtttgttccttctgatgtgtccagagtgtcttccttctggcagcttcatggtcttgctcacttcactaatgaagctgcagaccttactgatgtgtccagagtttattccttcttgcaggttcttggtcttgctcacttccttaatgaagctgcagaccttaccgatgtgtccagggtttctgtcttctggcagtttcatggtcttgctcacttcaagaatgaagctgccgaccttagtgatgtgtccagagtttcttccttcttgcaggttcgtggtcttgctcacttccttaatgaagctgcagaccttaccgatgtgtccagtgtttcttccttctggcaggttgattgtcttgctcacttcaagaatgaagctgcagaccttactgatgtttccagagtttcttccttctggcaggttcgtgatcttgctcacttctttaatgaagctgcagaccttactgatgtttccagagtttcttctttctggcagtttcttggtcttcctcacttcaagaatgaagctgcagacattactgagtttgttccttctcgtgtttccagagtttcttccttctggcaggttcgtggtcttgctcacttctttaatgaagctgcagaccttactgatgtgtccagagtttcttccttctggcagtttcgtggtcttcctcacttcaagaatgaagctgcagaccttactggtgagtgttacagcacttatagttgttatgtccagagtttgttccttcggatgtgtccagagtgtcttccttctggcaggttcatggtcttcctcacttcactaatgaagctgcagaccttactggttcgtggtcttgctcacttccttaatgaagctgcagaccttaccgagtttgttccttcggatgtttccagagtttcttccttctggcaggttcgtggtcttgctcacttctttaatgaagctgcagaccttaatgatgtgtccagagtttcttctttctggcagtttcgtggtcttcctcacttcaagaatgaagctgcagacattactgatgtgtccagagtttcttccttctggcaggttcatggtgttgctcacttcaagaatgaagctgcagaccttactggtatttccagagtttcttccttctggcaggttcgtggtcttcctcacttctttaatgaagctgccgaccttactgatgtgtccagagtttcttccttctggcagtttcgtggtcttcctcacttcaagaatgaagctgcagaccttactgatgtgtccagggtttctgtcttctggcatgttcatggtcttgctcacttcaagaatgaagctgccgaccttagtgatgtgtccagagtttcttccttcttgcaggttcgtggtcttgctcacttccttaatgaagctgcagaccttaccgatgtgtccagtctttcttccttctggcaggttcatggtcttgctcacttcaagaatgaagctgcagaccttactgatgtttccagagtttcttccttctggcaggttcgtggtcttgctcacttctttaatgaagctgcagaccttactgatgtgtccagagtttcttctttctggcagtttcgtggtcttcctcacttcaagaatgaagctgcagacattactgatgcgtccagagtttcttccttctggcaggttcatggtgttgctcacttcaagaatgaagctgcagaccttactggtttttccagagtttcttccttctggcaggttcgtggtcttgctcacttctttaatgaagctgcagaccttactgatgtgtcaagagtttcttccttctggcagtttcgtggtcttcctcacttcaagaatgaagctgcagaccttactgatgtctccagagtttcttccttctggcaggttcgtggtcttgctcacttcaagaatgatgctgcagaccttagtggtgagtgtttcaacactaaaaggtgttatgtccagagtttgttccttcagaagtatccagggtttcttccttctggcaggttcatggtcttgctcactttaagaatgaagctgcagaccttactggttcatggtcttgttcacttcaagaatgaagctgcagaccttagtgatgtgtccagagtttcttccttctggcaggttcatggtctttctcacttcaagaatgaagctgcagaccttactggtcttctgattctccgctagtttggtaaggataattgcctacagctccctagaggcaattatctcaattttctcaaaggacattatctcctttttttatgtttgcatattattctgcagaaaatttgttatcacagtttcttcatctattctatcatcaatggtcctttaggttgattcaatgtatttgttattgcaaaacaaaaaaaattgtatttcaccttactaagcttcataaataaaagtct

SEQ ID NO: 466826 - DNA, 1169 bp, Homo sapiens
tgtctcacatagtaaaccaaatatgttgctcctagtttacaaaagagctgaatattttagggaattctctctcattttaacacattgcttgcaggagtatacattggttatggccactttggaaaattatctggcaagttttactaaaataattcacatgcataccataaatccagcaatttctttcctagaattaagcccagcaaagatgtgtacacgtgtttaccaaaagatatgtaccaaaatgttcataacagcactattcatagtagtccaactggaagttgccctaataggcaagcagcttagatccaggcaagggaagacagaaccgtctttaaccagagaagcagaaacagttgtagcacagctcatagagaaagtgttggagcatggagtaaattcaactgcctgggtagcgcgccagctggaggaaggcagcaattggataactggatttgtgtcaggaaaatgagagagaggaggaagggagtgagagagacagacagagggagggagagaaagagagattgagctttcttcttcctcccttctatttggccttggaataccctgcagacaaagatggacttcctttagccgtgtcctctggcccaggctaccatcaccccccaaagccctgagcttgaaactggggtcaaggaagccttccacatgatcaatcagttacccaacctctttccctgttgtggctctgccctcctctggggtcttggagttctcaccataaacagcaattgtcgccacaaatgaagaatgttcacgtttgttttacaacttcttaatgcaccgcattcagtcttcctgtaaacttgactgcttagtccttaaagtatattggtggagcaatgtctgcatgccttcgtcaacacatctattggcctgtttgtcccagcatcccagttggaatgggaacccttctaagaaaagcctttatcctttactcacctacaaactcactgggcacccccggaattgtggtcctgggcgtatagcaggtgtctagtcactcttttctggttgtgccagtaattggggcctgattacaattctgtttcatccagtgcacctcaatggagagaaaccagcaagaaactcatgctttctgccccatctccttcctttcttctgtgtgtaaagtggagaaa

SEQ ID NO: 466827 - DNA, 1989 bp, Homo sapiens
tgcttagtgtcatttctcgtgtgtatacacctacaagtagaattaaggtggagcctacagaggcaggcaggcctccttgagctgtggtgggctccacccagttggagcttcccggctgctttgtttacctaagcaagcctgggcaatggcgggctcccctccccaagcctcgctgccgccttgcagtttgatctcagactgctgtgctagcaatcagcgagacctcactggcgtaggactctccaagccaggaagtctgtcccaggaagttttcaaacctctcttggccagagaacatcagtgggagtgattggaggccctggatgggaagtcccgccaagctggaacagctgagccatccaaacagcaaggatgacaaccttccctttctcctaagaactctgccccattcaagcttggcccaacactgttgccaggggctggctggaattccaagctgatttcaaacatttaggttcaagggatgcagatgcaggtttgttacatggataaactgcaagttgtgtagatttggtgcacagattatcttgttacccaaataatgagcacagtatgctgtaagcagttttctttgctcagcctcttctggccctccaccctgaagtagatcctgtgtccattattgtcttatttccatgtgtactcagttttaagcttatacatgtaagtgagaacatgctatttggttctctcttcctgtgttaatttgcttaggataatgccttccagctgcatccatgttgctgcaaaggacataattttattctttttttatgctgtctggtattccattgtgcatatatttatttttatgtatgtactttttaaattcagcttactgttaatggacacctgggttaatttcatgtctttgctagtacaaatagtgcagtaatgaacatatgtgtatatgtatttctatcatagaataatttccatttctttgagtatatgctgagcagtgggattgctgggtcaaagttagttttgttctaagttacttgggaaatcgtcaaacaaatttccacaatgcctaaacatgagcagaactacagttcccataagccctgtggacacctcctgtgggagatcagctgtgcccagtgcctgagctcatccacacctgttcttcttgctgcaactttgcacctgatgggcaacaccttggagctgatgggcaatgaagcccacaataacagaaagtgctgtaatattgtctgtgctgccttctctcctttgtacatccagcattttgagagtacgcaggatcaagaacttagttcattctgcctgcttggaagcactctagaccctatagtcttcagcacactgctgcggggcccacacagagtttgcctctggcagcacccaaaagcattcaccctggctcctgtacctgctcacctgtatgccccatcctacatattgtggcatgcagcagatccaactgagtggcattcaccactaccggtgccagtctggcctctccaaatacaaaaaccagacctttttttaataccaggtagctcctacagcttcaggctcctggctggtaacaaggcactgaaactcaatcttctcctagttccaagctagaaaccatagctataaaaatcaggcctttcaattaaacgaggtctccacacatgtcacagcattaggtggaatcccagcagtcctgaaaaacagattttccttatcacaagactaaagaagaaaagaagcttgtggaagtcatggaacagcataaaaaagacaaatacttgagttatagatgctttaaaaaggagaataaaaggattgaaagtttacttaaataatagctgaaaactttccaaatataaacatacttataaaaaggaataaatatccagatatagaaaataaaatgtctttagactgcaccctaacaaggccattccaagacatattataataaaactgtcaaagacaaaggatgcttaaagc

SEQ ID NO: 466828 - DNA, 916 bp, Homo sapiens
tgtactcacaaccagacaacttactcagtctgtgacccaggaaacggccagcgttataatgagagtgccacaggttgaggagacagtgaaggcaaatgccaagcaaggaagatacagccatagcccagccccagcaagcagggaatgcctagtgcagatgaccacaggtatctggcaggcagagactgaattcacagagagccttgacagggctgtttcagtattccaggcagatgatgaggaagacccctcttgcagccacaggacagggagtgggaatgtgccagcgctggttactgggtggatggaagatagagcaaatgtggatgtgaggctatgtatagagatcaggagtagaataaaagttatggaaagggtccacatccgagtaattgctaaaaccctaggaggggccgccgtccacttgcaggactcccgctactgggttatggtctccatgactgatgtggcttcggcaagtcgtgaccatacgggggaatcaaacccaggtcaaagagtcaccaaagtgagggtgggagaatgtggaactacactgaaggacacctggctactcttaagaaatccccatggtccagcattacctggaaagaagctaaagctattatccagcaatacccagcttgcattcctcatcttttacaggaagagttaatccttgaggattggaacctaaggatctttggcaaatggatgtcacacatgtttcctcatttgggagactaacttacgtacatgtatgtgtaaacaccttttctcacttcgtctgggctacgtgccaattaggagagtcttctgcctgtgttaaatgtcaacttttgcagtgttttgtgttgatgggcagtccagcttctattaaaatggacaatgccctaggctaccctaatgaagctgtagc

SEQ ID NO: 466829 - DNA, 2683 bp, Homo sapiens
taacgtgcaaccattaccgccatccgtttccataactcttttcatcttgttatacaggaagcatggtgccagcatctgcttctggtgagctcagcaaactttcagtcgtagtggaaggcaaagcaggaccagacaactcatggcaagagagggagcacaagagaggggatgagctggcagctgctgtagtcggattcactggcattgactgccacctggttggggaggagtcctatatctttgcagattccatctcagagatgagacattgtcccccttctctcagttcagccctgttttgtgtgcttttgtgttcatggcaccaaatccacaccctgcatcactcagagaatgagtccccgttccagaatcctcagggaatccccagaagtcactctggccatattgacttcagccacacattcatgcttgcatcaatcctggtcagagcaatagagagacagtatcttctttacccccagagtctgcacttccaggcacttccacgggaagggaggtgtggaatgaatgcaagacagatctccctggaacccgctgcaaaaaatgagtgtgggatggaaaaagagagcaccaaaggacagtgtgacaataaaaagtctaattttattctgcagctagttcaggcaataccaaaagtggatctgaggtggtataattgaattaagtcaaagtggttctatcaaacaataagatgtttgtgccatcagctatagactgtgagttcttggatgtggcagtttatttttctgagtctcagttttttcagttgtaagataataattactgttgtgtagggttttattgatgattaataaatatagtgttttataaagtccctactgtaatatctggcaaaaaaaaaaataggcacaaagtgaatggtagaattaatcatcaaaatgacaatttattgctatcatttttagtacattttgggtactcccaaagtgctagttactatattttagagttgttttgataaatataaaagatagtgtctctaaacaatgtagaataagtgggtagaaaattaatgttagaattaataacaatatattctatttaatattacataacatgtagttagtatttatgcataataatttattgttaatttcacattttatataattccaaggtgctaatttgaagaacaatgcttccctaaatatttaaatttaatgatggtagcttataaggtttgtcttcttactatgtggttctatatcacagtcattgcaaaaggacaataaattaacagtgctttagtgatggttataattcactattactacttgtcaatagttattaataaaaggttaactcttcatatgtgttcatttgtttacagtgctgtatacttcctgccttttgatactaaacaccttgtgaatacaatgatctaacttttgggaaagcaaagtacagatggccataactggattctggggatggggtctacccctggcaatgccttgcctgcttgtactttcagttatgttctaaagggcttatcttcagcaatcttattcctataagctgcttttaaaaacttagagatgtcaggcagtgggtcagatgagagctgtgcagcatggcagtatttagagtatttctgttttgaattgttttgtaccactcaaaacttcaatatatttctcacatcatagccttccacagtcacatatgcaaattcatattcataatcaaacttgtggattattcatctctgacactattattaattcctatggcattcttatttttagttccaagtgttctcttacttaaaagcctttgttgtcatcaattgttaattttagcattataatccgtgtgattgtttctctagtatttcctaagcattttttctgggttcttgttcacctttcaacccttttaatacatcccagaacacttaaacttttgcttaagtctcaaaagcacatacaattatttgaccaaataagtacatgattagaaattcataggtctcttaaaaatattttatgtcctatattaaatgtcaaataagagatagaagtttgtgattagataatattagaaacttggacttacttttataagttaagtaaactaatgttcagatgcatacaattcttactaaatacccctacctgtaacttttaagcattgccatttatcaattaacagttattttattaagcaatcattgtatgcctggatattcgtttgctgacatcttcatgtgcaaatcattccttctaaatcttaagaatacacacataagtgatatattccccttatatgttatagatgacatgaggaatgatttgcatttaggatgcatgatcaagtgcattagctcttcttgcaatttggtcaccagtgaaaagaaatttggggaattttgacactgggatgtaataaaatgggttatcaaaagacatgcttttttttaaaaaaaaagaaaatattttagaatgaggtatgccttacttacaaaacgaatgaggttgtctgtttccaaatgaggggttttaaaacatgtagactagcagtcaccaaggtgaaatgttttttaaaaggatcataatataaaaaatgacaccaaggcatagagtttaagagatatcaagtatgtgtgagcaagggtacatgaaataaatagtttgacttt

SEQ ID NO: 466830 - DNA, 692 bp, Homo sapiens
cactttgcatttcctaagaccatgaaagagaaaaagaaccagaggcaaaaatgtggtattagtaataatgaattggagagcatggaggcaggggaagatggaaatattccgggttgggagaagtttcctgagagggtttcaaggaaagtttggtccgggccggtgagtggcttagagaccatcagtgaaatacatatggcaagtgaagccgtggtaatgggtgatgtcacaccaaagagaggacagagtcataaggaaaaagatgaaaagcagacaaatagaggagggccctcccgggcccagactaatgccagcctcagtgcctttctcaacacagtctcatacttttcatgctcccattttcctcataattttacaggactccgttttctctcccctactagaatctacctggataactctcccatttattagtagtttgtgccagcttttccaggcagtgcttatttttcttggaaaagatagaagagtcagagttgaagggccaacccaaggatgaaggcactgcccgcccgcctgtggtgggcatgtggatgaggaatccgtgcctgcacatagcactcaagatccaccacactgacttctttaagggaaataaaatggagctctctgccccagaaattgttcatcatatggttgtgcatatttatatagagactgttatattttta

SEQ ID NO: 466831 - DNA, 1306 bp, Homo sapiens
gcgatagttgatagtcccttcatggtcgccaaaatgtgtccagaattggttcctaccagtgggttattggtctcactgacttcaagaatgaagctgcagaccctcacgatcccatccttctatggtcatgctctggttctccatcacaactgccagaaggactggactgaccctcctcagatgacagaactgaagggagccaaagtcctatttgtcctacagtggatccaaacaaaggccctctatcccctgtatggcctgcattccaaggatggattggggattcagatgtccttcatagataaggagtggatctccagagttctctcacagcagtgctggcatagacactactcaggtttgcgtggttctaacaactcagagtccgtgacactcttgtccttggatgcccttcatctcatgccccatgacttgagacagatagatgttctagcagattctctccagatatggaaaactgcagatgactggaagttcctgcaagtaaaaatctcccagatgaatttgcagagcaagcccgcacctcccacacaaaaggacaagagaactgatcctcttttctcatcacgtctgtcagtttatattcttcaacccccacaaagaagtgagcaaatcatcattcttcctttgaccaagaaaaacaatgcctttctttacatctactagtagaagcaacattatgaaataaaaatgaaaaacatccaagcagtcacaatgtttaaataagaattgttggtgcactgtctccatcagttgagtaaaagtttaaaattgtttcctgcttgccggttcacacctctcaccctcttctttccacatgcaaacacgcatttttcattttcacttaaatcttataagagggaaactcaggcattgagaagactgttcggtgtgtggtaacaccctggactacaatctaaagatggaccctgctcgctcaatctctagtttaattacctttgcttaaaatttacattcctatcaaccttcatggagccatacatttgttcctacaacctacatgacatctctgctccaaagagttcaaatgttgccccatatatgcagaacatttattgacttgaatttatgatgccaggagtgatagtaaatcagcgagaagtgggagaaaaactgttaagaaccctcacaacaatgaaagccagtttgccacattaatatttatctaatcagtggtttccttgctgcttcccaaggtctctagtccactattaaaatttgcctatttaacaattattttctatatgtctgttatgtaaggtat

SEQ ID NO: 466832 - DNA, 1450 bp, Homo sapiens
gttattctaaagagaaggcatctgatcctttaaagaccccactgctaatgcagaggcctgtcatcagcccattagcttttctgcaggacacttggagagtcccaggccatgagacactgtataggacctcgtggattatttacgggttcactcgcatagtgctgtttatgcttcatccatgagcccaccgatagcagagcaaatcatcagatcactaaaacttatcatgggactggatgggaccactcaagccaccgagcctcaacccatccattgcagcagatctcaaaagagtgagctattccgctggcttcccatctacccttctcatgaagtttccagcccctgcagcctgtcccccgcctgtcctctgcctccttgctccatggatcctgctccctctaaagccactcctgcctctttccctatcactatttgccctaatcccacactctgttctttttatagttcccgctgcacaagtaccctcacctgtttcctttccaaaacagcttgcggaccctctacccccagagatttctgcatgacatgcttgctgcattctaacaagccccaggtgctgctgctagtccagggaccagcctttgagaatcactgctgcataatgaccctgtagtcactctttccctcccatcagacattaatggcttgtggatttcttgtagatagaaaccattaaatctccataacagacagagttttgttcttcttgttgcccaggctatagtgcaatggcaagatctcggctcattgcaacctccacctcccggtgctgggattacaggcgtgagccaccgtgcccggcctgaatgtagtatctttcttctgttttcttttcctgctctttaaaaaacaaccttcaacctctgattatttattccaacaacagctcttcagtagggtaaaagtcttaacagttcttcaaacgaacaatattcttttgtatttttcttcagagatagcaaatgttataaatggcctactctgatttaaaaacctaagttccgatgatgatgaaacattaactcttaaatatacattttgatttatagcaataataacaattgtaacaacagcaattaagaacagcatctggtgaattcttggcaatgtttcctggtctcaaaacagtaagaacaatttgaagtctgttctttagaatgccctactcagctgcataatgtttagaaaattaaagagtctgtattttaaatatttttaggtaattattgcgggacattgtcttatggtgtcctgatgtacgtggggtgtgcatgtgtgtgtgtgtgtgtgtgcatgtgtctttgtgtgtgtgagaaggacagagagaaatgtatgtttcactgaaacatttgaaacgaccaatttcactttattgtgcctgtaaaatgttagttttaaaataaataaaaataatatgaaaataatt

SEQ ID NO: 466833 - DNA, 987 bp, Homo sapiens
aactttcacttaggcattgaagactctgcaaaattcctgccaagttagcttcctccccatgagggattgccacattttcttgtctatatgtgaagaggagcaagtgattagggataaaaataaacaaagcaatttaaaagaccagccttctgaatatgaaggctttacactatttgttatcaagattaaacctcatactatccttgatgcattattcacctacagtagcacattatttgctacgaaccgattatcaattctctgtgaagccagccatttttttcctgctggaggaaaccacttctcagaggatgccaaacaagggcagattcctcactcccccagactcttgatatctggaggtttatctagtccaggggctggcaaacagaaccacaagccaacagtggcctgctggatgtttctgaatggtttcagcatcttcaagatccaggaagaattccacggccacaccttctagcaggaagttacctagatggctgcctcgttcttattctccctttgtttaaaaccaacactcctggtaatcaaagcctgtttcataaccaaccagcttatgtctaatattcattagccactcaactaaaatatacatagaaattgctaaatacatttctacatttataagtccttcaaggagcaaacggctaaacaaactgtggtacattcatcatagaacaccactaggaataaaaaggaacactattcatacacacaacaacttggataaacctcaagaaaattatgctgaatgaaaattaccagtatgaaagaaatatatgctgcatgattccatgtatatagaattcctgaaatgacacagttagagtgacagtgaacagcgtgggagccagttgggattctttaaaaggcctgctgtgttgctgagtgtcctagaagaatgtagcattgcagtggttccggctgaaccaataaatcatgacctgaaaacaccagccattgtgc

SEQ ID NO: 466834 - DNA, 1170 bp, Homo sapiens
cctgactcacaagaagagaactgaatgcccagttcttacccttttgtcaaaggtcacgaccaggtgactccacgtttcctagaagacgaccacttgtggctggaaactcaccatcccccattgtgggaacatcaagatcagatgccctcaaaacaggcagcagccacaaaaggtgctgtccagcagtttctgctgccaagacaatttggatctgctttccatccaattcaacctcagttcctcctcatcctctccggctttccaatgatcccgtgtgatcctgaaaatccctgtggtaaatttccatctggcctaagaggaaaagggggaagagtggattggagagatgtgatgtgggaagaacccaacccatattgctggtttgaagatgtgggaagggggcctgagccaagggatgcagtagtctctagaaggtggggatggccctcagcttacagtcaacaagcaaatggagaccacagtcctacaaccacaagaaactaaattctgccaacaaccccaatgagcaggaaaccaatgctccctgagagactccagaaagaaatacagcctgctgacatcctaatttcagcctgaaaggccatttgagcacacagcaagaaggcaactgtctacaagccaggaagagagccttcactagatactgaccatgctgacatcttgatcttggacttcccagactccagaactgcacacatcaaggaaaggctgtgtgaggacacagggagaaagcatcatctacaaaccaggaagagagcccttactagaaacctaaccctaccagcaccttgaccttggacttctaccctacagaactgtgagaaataaatttctgttgtttaagccatcaagtctgtgatattttatgatggcagcctgagaagactgataaaaagctaaaacacatttaaatgaaaaaaaaaatatttatttatataatgtaaatatcttccagcttgatagcctctgtgggtgactgcattttggctgccacaatatctcccctcccacatgtacatctaccacgtgacattgagtatctcccatcccacacgtttatctaccacgtgacattgaattgtcaccaatcaagatgtacaatctgtgactttccctttggaattgcacaaacttatgtctcattagtaa

SEQ ID NO: 466835 - DNA, 2570 bp, Homo sapiens
agttccggggatcctgttatgggtctaagttccagggcagatatttgcagaaaggaatccgaagacctagccatgggcccaattcccaagaccgatgcaatgctgccagcaagggggctgagctcacacaaactatccacagcagctgcagctgaaatcagttcaaaggatacggaaataatgacaaagaaacaagggactattaatatttatcaagcagatttgaaaaacaatcacacagatgttttaaaggtgaaaaatataacagcctgggtgactgagcaagaccctatctctaaaaagagaggagacgagaggcgaggcgaggagaggagaggaaaggaaaggaaaagagaaggaaggaaggaagaaaggaaggagaaaggaaggaaaggaagaaaggaaaaaagaaaagaaaagaaaattcttatggataacttgcagcagcctccctctccatcagcatttgcttgcttcaccttgcacttttattaaaaatatcttttgagagcaaatgttaaatatagacattttcagacaaataaaaactgagaaagcataaactgggtggtgtttgtttaaataatataggagagagctatatagtgaaactgaaataaccctattaattatataaacatatatattatatgcactcttatgtcatactttgattgcttggttcagcccacgaggccactctgagccttcacatcccctcctttcaggcaagaatacccgataaccagtagattccatgaatctcctgattcactcagccatcactaacggcaaaaggagaactggatcataaaagcctaaagaatttggagagcttcaaggaagatataacacagatttgagtccaaaatatatttttacaggagaatactgaatggaatatttattgttaagcatctgagacagctttgtttctggattatccccagcagggattacagaaagcttatgagatttgtatattaaatcatcacaaaaattttttcagtatgtataaggagatgtatttcttaatagaagggaaaccagtaggaaataataattaaacatgatccttcactcatgatgtatggtggttccaatatccttctgccactcaaggaatatctgactggtaagggaagaatacctcaagcgagcatgcgtacagctccagtaaacacactgcggatgctcccctcccaagggcttgcaggccactgcacatgtacacagcctaccccacggaagaatcaggggagaaggaccacaagactccggaaacatgccaacatataaaacttcaaatcaaaaggtcaaaccaaggacttgatctctcaggtcactctcttggccctcttgcaagtgtactttacttcctttcattcctgctctaaagctttttaataaactttacattgaactttagacaactcttggtctaaaacttgcctcagtctctccttctgccttatacctcctcagtcaaattctttcttctgaggaggcaagaattgaagttgctgcagacctgtatggattcgctgccaataacacatgtatatttatgcttgtatgtgctcttcttaaagaaaagaagtttacccaaagtgttaggtgctaagacgtcttccctaaactccacctgattggccttcaaaccacaagctgactttcatgtctttcggggtggtgtttggttatgaataagttctttagtggtgatttctgagattttggcacaccaaaaagaaggatatttgtggcaattgaaccatctcagtcttcctcgtataaatattaagccaaagagcgtgcagaggaatgtcttacccataaggaatgggtaaggaatgtcttacccataaggaatgggtaaggaatgtcttacccataaggaatgggtaaggaatgtcttacgcataaggaatgggtaaggaatgtcttacccataaggaatgggtaaggaatgtcttacccataaggaatgggtaaggaatgtcttacccataaggaatgggtaaggaatgtcttacccataaggaatgggtaaggaatgtcttacgcataaggaatgggtaaggaatgtcttacccataaggaatgggtaaggaatgtcttacccataaggaatgggtaaggaatgtcttacccataaggaatgggtaaggaatgtcttacccataaggaatgggtaaggaatgtcttacccataaggaatggaacatagcacttttagatgtgtaattcatctaggaatatgtatatgtgtgtgtgttatacccatgagagaggtattcaaaatctttgggaattttgacactgcatcaacccataaggccaaaacccaggacaatgttgtggaatgtattattttttcacaaccctatcttttctctgaggtcacttttaacagaatatacttttatattctgttaaattcacttttaacagaatatactattctacaacttactgactttgggcttggccatgtgtcttgctttggtcaatggagtgtgagaagatataatctataccttggctgtccaaaggttttgaatgtgctc

SEQ ID NO: 466836 - DNA, 2046 bp, Homo sapiens
cgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggagccagcccctccctccctacccctcctcactgaggccctcaggccccagcagttccaaccaagggagggcctgggcttgagcatggctggcagctctgggccccaaaccggttttcccacctcacctgaggctggcacatcacttctgtgtttccttcccatccccggcccacctttaccaccaagtttctcctctccaacactgggaatgttaatgggggagtatccagttcatctcttgtccctggcctgccctggttatggcccctt

SEQ ID NO: 466837 - DNA, 3114 bp, Homo sapiens
cgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466838 - DNA, 3137 bp, Homo sapiens
cgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccagcccacccccccccccccccccgcgccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466839 - DNA, 1754 bp, Homo sapiens
  misc_feature (12)..(12): n is a, c, g, or t
  misc_feature (22)..(22): n is a, c, g, or t
aacggctaggtngaggctgggnttgaatcggccgaggaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466840 - DNA, 1713 bp, Homo sapiens
  misc_feature (12)..(12): n is a, c, g, or t
  misc_feature (22)..(22): n is a, c, g, or t
aacggctaggtngaggctgggnttgaatcggccgaggaggggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466841 - DNA, 2850 bp, Homo sapiens
cgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcgccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466842 - DNA, 2474 bp, Homo sapiens
cgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466843 - DNA, 648 bp, Homo sapiens
aattcaagcttctaacgatgtacggggactcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466844 - DNA, 2033 bp, Homo sapiens
tacgctaggtagaggctgggtgtgtatcggagagggcgctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466845 - DNA, 3040 bp, Homo sapiens
cgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccagccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466846 - DNA, 1833 bp, Homo sapiens
ggggatgaggaggagtggcgggggggtgtgaaggatagtgaatgggtggatggtgagagtgggtggaggatgaggtgtgagtgtagatgttgtgagtaaagaaggatggtgagaagaagtagatgatgcttggatggagattggaagagtttttggtaagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466847 - DNA, 2720 bp, Homo sapiens
cgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcgccgccttgagaagcacagtttaactcactgcgggctcctgagcctgcttctgcctgctttccacctccccagtctcctccctctctggcagggccccatcctgggcagaggggcctggggctgggcccagagtccagccgtccagctgctcctttcccagtttgatttcaataaatctgtccactccccttttgtgggggtgaacgttttaaacaggcagttaaacgttccaatatctacacttaacccactacgacatgattaccttcactgttaccctacacaatcaatccttagggggccccgttaaccaaaaactccctaaggttgtgcgtttacaatattaccgccttactctaacattactatgatttcaaaaccttggagattcccaattaaagacctttctagaaaatccttgttttaacagatgtaaacagacttacagggcatcccccatttgtcctaataaaccctaacccctgtcctaaccgcataaatttccttttgccaccctttattttaatggtttaaaattcctgttgtgaatattggatatcctctcctcttctttttttaacccccatagtgacaaaatttggttgttttaattaatttaaccaaatgtgacctctttgtaaggtcctttgtaccactttggaatggatattcccttcatggagttttttcccc

SEQ ID NO: 466848 - DNA, 1828 bp, Homo sapiens
cgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgatacacggatatgtccccgcgtcaagacacgcgggcactgtatgatctgtgacctcaatctaacacctccctgtcata

SEQ ID NO: 466849 - DNA, 687 bp, Homo sapiens
tccacttcccgtgttcctcaaagagaaggtggatcctttcctgtgggctctgcatggtcttgaatataatcatggccaaaccttatgaatttaactggcagaaggaagttccctcctttttgcaagaaggagcagtttttgacagatacgaggagtcctttttcacttttccagatacttttttcttaactgtcaaacattttctgtctctcaatctaaagaagaaaacttcaaaattcaagtccctcctcatcctggagctgtttggctcccctttcacctcaaactctcctactcagactctcctgagatcctcccttttgcataagcctgaaagtcaaagtatgtccttaaaacacacaaaatctaaaaagagctttattcttaagaaggagactgccatcatagataagtgttcaccaacagaactttccacaatgatagaaatggtctacatttgtgttgccgttatggcagccacatgtggctgttcagcatttgaaatgtggctactgggactgagggacttaagtttttaatcttacataatttaaattcaaattcatataggtacatgggcctagtggctttcttattggatggcatagataatcaactcaaactacaaccagattttaaaattccattctcccttcttgacactaagaagcattctcagtgcattcc

SEQ ID NO: 466850 - DNA, 1300 bp, Homo sapiens
ctctctctctctctctctctctctctctctctctctctctctctctctctctctctccatgctaggatgtgccaggagacgaaaaccatggcagagaggtggctggaaaggtgaacaaagacactgcccccggccacatcttctgagctgtggaaaggcgagcaaaaacatgctgcagagcagccagctttccccggtcactgcatgttttaaagaggtgacagacgaggtctctatctccaccctccccttggcttcttcgaacattcagaggcggtctctgaaccataaacatgaaaatgctatccctgaaggctggagtaaatcttctaataacctcaacgtgggaagtgacaccacatcagaaaccagcttttctctctccaaagaagcaccaagggagcatctggaccaccaggctgcacaccaacccttccccagaccgcgattccgacaagagacggggcacccttcattgcaaagagatttccccagatcctttctccttgatctaccaaactttccagatctttccaaagctgatatcaatgggcagaatccaaatatccaggtcaccatagaggtggtcgacggtcctgactctgaagcagataaagatcagcatccggagaataagcccagctggtcagtcccatcccccgactggcgggcctggtggcagaggtccctgtccttggccagggcaaacagcggggaccaggactacaagtacgacagtacctcagacgacagcaacttcctcaacccccccagggggtgggaccatacagccccaggccaccggacttttgaaaccaaagatcagccagaatatgattccacagatggcgagggtgactggagtctctggtctgtctgcagcgtcacctgcgggaacggcaaccagaaacggacccggtcttgtggctacgcgtgcactgcaacagaatcgaggacctgtgaccgtccaaactgcccagagaagaagaaagagaaggaggaggaagaagagaaggggaagggcatggaggaagagaaggaggaggaggagggggaggaggaggaagaggaggaggaagctgcaaccaagaccatatgtgacccacaaaacctaaaatatgtaccctctgaccctttaaaaaaggcttagtaactcctggtgtatagtcttactgtgtatttcccattgccaggtagaataccagcctaaaataatatcttagagcctttcaagaaaccacacattccaaatggctttggctgaaaaaaatttcagagacagaaaatctgatccttacac

SEQ ID NO: 466851 - DNA, 926 bp, Homo sapiens
gaagataccgcgatgcccaactggccacgccaccaggtctggccttgcgtatccgcctccaaggatccaaagccggcctggggctgtccaatcgagtccgtggagagcccggagctactccatcgccgcccctgccccaaggcggtcgcgccctcacccctcgccgcactccgcccccaaccacccccgcgtgcccccgccagcctctggcccctgcactcagctagggggctgtgttccaactcccacctccatccccacggtggcgcagccgaggaaacctttcttgaccaaggccaagcccaagcccaagcccaatcctgcctgagcaaaaggaagggcggagctacccggtggaacggcctagccgctagcgtggctactccaacctggggcccgagcccctggagctggcggccgcggactgcgtccctggggacactggaggggactccagggacagcgtgggtgggcctttcccccgcacgcgcctctgtcactctctttccgggccagagccggggcagcgctctaaattaaggtcgacctccagcgctgggtgaagtcttgagtccgcccgggagccctaggtgagggtggtcgcggtttggcgggggctagcgggtcagcccctatttctgcccccaccccgattgcctctcgatgtcggcccccgcgctccctccctcgccggcgctccctccctcgctcgcgctccctgtacgtcgccgcgtttaccagcgcgttttgttcccctgtcggattcccggccgaggggctgtaaccgtgttctcctccgatggacgctaatcaagtaatttccccatcccagccccatcaaattgctctttagctgttgaaccgcggagttttgctcgccttttcacatgctaatcacgcccattcagcggctctcggtggggctg

SEQ ID NO: 466852 - DNA, 908 bp, Homo sapiens
gaagataccgcgatgcccaactggccacgccaccaggtctggccttgcgtatccgcctccaaggatccaaagccggcctggggctgtccaatcgagtccgtggagagcccggagctactccatcgccgcccctgccccaaggcggtcgcgccctcacccctcgccgcactccgcccccaaccacccccgcgtgcccccgccagcctctggcccctgcactcagctagggggctgtgttccaactcccacctccatccccacggtggcgcagccgaggaaacctttcttgaccaaggccaagcccaagcccaagcccaatcctgcctgagcaaaaggaagggcggagctacccggtggaacggcctagccgctagcgtggctactccaacctggggcccgagcccctggagctggcggccgcggactgcgtccctggggacactggaggggactccagggacagcgtgggtgggcctttcccccgcacgcgcctctgtcactctctttccgggccagagccggggcagcgctctaaattaaggtcgacctccagcgctgggtgaagtcttgagtccgcccgggagccctagaagagactggggcagcatgaatgtgctggaagattagaggctgctgatgctgaaggaaggagaaacgaggaggaagtgtccctgtggacaagtcatctcccttcatttaagccaggccagtagtccgggagacattctgaatgatgcattatcctaggcaccagaaagtatctaacattctcatggacagcagggaaaaatgagcacatgagacaggggaagattccagcacctgtgaacatgtttgtgcaggtttccagtcagtacatggatatccctcaagcctttgaatccagtctcctgtgttgtgattggacc

SEQ ID NO: 466853 - DNA, 743 bp, Homo sapiens
tgctgggaaatggtgcagaatgcttttgctacactcaagattctcctgagattgatcttgaagcaaaatgctgtggtttcagccacagcatccggcgaaggtgtcctgggtcattggaaccctcctgacctgtacaggctgcaagccactgataacttcatcagatgggcagacatgaatcaggggtcaggaagggacacgctgacacttaaagacacaacatttcctgatgctgtgtttttggtgacaaagactgtggattttgtcttgctcatactctttttctggctttattcacttacctgctctgataaattctgctgccatcctgagagctgcaccacggagaggcccacatggcaaggaactgagggctacctttactgtagcctgtgagagaccatgggccaagggatccaggacatcttctacagtagtggtaatcctccatatttcagctgacacctctatgtgagctgtggtcatcttagtgtcgagagagtcccctctgcccacatgaaaaccagtcagagacgagctgttttgaatcaagtctcctgctcttgtagacttttagtttgaccttggaatgttcaagcagacctctgcatttaatccaagattgaggcaagttttctctctgcctaggtttatcttgtctgtctgtgaacaaaagagaggatagcaaagtaccttgtttggatttgtctataaatgtgaccttcctaaactggctaacaggg

SEQ ID NO: 466854 - DNA, 607 bp, Homo sapiens
tgattgtcaatattatttgtcattttttacatttaggttaggaattttagtaacataacaacacttcagtttagtatatgttaatttgaaatataaatatacatatgttcttttccacatattatccaaaggctgcgagcttggagtggaagaataaggagaatcaagatactggttttaaatttctttttacattgtttcgaaagtattatcttcctcatttatttccatcatttactaagttaacaaacatctacaaacctgtacttggtaagtactgttggagccgtgtatagaggatatccaaaggaaagctatgcagtctctttcaaagtgacctttgattattttaaagtaaaatagtcattttatttttgtattgaatggtaactttattattaaatgtttaaagtttcttaataagtgattttaattatttgtaccaactaagatatacctcagcttacagcagtaaaagggaaccgtggctcctatactcagaaataatttgaaatgtatttatgatatttttggtataattacattgtcatcttttaatgtaaaaatctctgcatttcctgaagtctttccttgtgggtggtggggt

SEQ ID NO: 466855 - DNA, 974 bp, Homo sapiens
cacctggctatagactggtctggtatgattaactttattttacagagggataatgtggatgcaaatgatcttaagcagttttttgagaccaactattctcagatatatttcatcttctatgaaaattttatagcactggaaaatagtttgaaattaaaagatatgccaaagagaagctgtacagtgcttcctttaagtgaaaagataagatgtgaaggaatcaggctgtttcttctgtggcttcaagcacttcagacaaactgtgcagaagagcaggttctgatttttgcttgcctggtgcctggtttcccagcagtcatgtcatccaggggcccttgcacactggagacactcatcaatcccagccctagtgtagctgatgtaaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttggtaagtactgttggagccgtgtatagaggatatccaaaggaaagctatgcagtctctttcaaagtgacctttgattattttaaagtaaaatagtcattttatttttgtattgaatggtaactttattattaaatgtttaaagtttcttaataagtgattttaattatttgtaccaactaagatatacctcagcttacagcagtaaaagggaaccgtggctcctatactcagaaataatttgaaatgtatttatgatatttttggtataattacattgtcatcttttaatgtaaaaatctctgcatttcctgaagtctttccttgtgggtggtggggt

SEQ ID NO: 466856 - DNA, 1052 bp, Homo sapiens
acagaagcgtctttccaggtccataaataaagcaaagactggctggagagggtaaggcatggtctctggacacctgggctgtgcactgcagcagtgcgatgagggacagctggatgctgacgagcctcggcccgctttcctgacctggctcccaggatgctgcagtcagtcttcaccttccagtcaggagacctggagagtgttctctcgggagtctgtccagccaaagaagaaagagttaaaggtactgaaatcagcagtttcccagaaacatggcccatctggagtctcctacagtggagctgcagatgctgagtgtggaatgagaagttccaacacaggaggttaccgagtggcagcagactctggaaaagacctgttgcatttggctgtgcaggatgtacactgctcaacttctgatcatgccattcttttcattttctctgtggatgacatagaaatagagagaaatcaggacaatttagagcccctctgaaggctcctggggagacctccttaggaaattaaaatcaatagaaaacctcatgcagtaagaagaaatttagacaattgatagcatttgtgattgagtgaacgataaatacacagaaatctaagcaaatcaaaagaaaacaatgattaactttggagtattaataactacaaaaattaaatcataataagatctgaggagtatttacatattcataataattcaagcactgatgatttatctctaactacaaattttgaaataattatgttgggagagccagggttatgggaaagtggcgtgtgtgcagaggggtgatataaaagtcaagatgtagcaataaaaacatattcttcaagaaaggttagcatatgccaaaacagtcagctaagatccatgaagggggctgatgagtaggggcaatgatattttataacaaaacttgaattgttacgctctttaaactgtatgtatttgtaactttgctaaaaatagaaactagtaaaagttttaaaagttctttcaactctgggaaagtcatttaatctctcttagcctc

SEQ ID NO: 466857 - DNA, 1835 bp, Homo sapiens
ttcaaccattgtggaagtcgggacacggatgaagctggaaatcatcattctcagcaaactatcgcaaggacaaatgagaacaggatgcccacttttatcactcgtattcaaaatagttctgggcatccaagccagaacaatcaggcaagagaacgacatgaaagacatccaaattgaaaaagaggaagatacaatatcaaatataaaaatcaggggctttatgtatgtcaataatgaactagctaaaaaagaaatcaagagggtaatctcatttgtaataggtaagaaatacctaggaatatatttaacaaaggaagtgaaagatctctacaaggaaaactgtaaagcatgggtgaaagaaattgaagaggacacatacaaatggaaaggcattccatgcacaaggatcagaagaaacctaatgttgttaaaatgactatgctgcccaaagcagtctgcaaattcaagaccttcttctcagagctctgacttagcttctgatgtagctggcagaatttcttctctctcattcccaccaaagtatatatctgttgaattgttgaactggattatgtcagaagcattaattggaaatcatcactctgtagagaacaacaaaaacacaaaatctcatgaccaaggaagagcaaaagaacttgtcgggatttctcgacctcacctctcagaatgttgacaatgaactacaaccaaaacacaaccatggcaacaaattagatatttgttgaatcaggccaagacacagaaatatactgcatgccaaaatgtaaaggtgacatgagtgatcaaaagagagggaaagtgaaaggtcaagggagaaactctcagcatgtaggtacagaaccatttccatgaggtcagctacattccaaagtggctgcggcactggatgggagctgttgggacatgctgcacagcccaagacagtctttgaagatggctggatgcatgaccttgtcatatacgtaaaacatccacagactaactggaaaaggacttcacctcagccaaagtgagtgcattgcagaataagtgcagagagcttaccttggtttttaaagatattgcaatccgttttaattggggatctcattgcaatgtgctcctatgtcttgagacagggccttcaagaggatcaatatttccaggatgttggtattagcatccattgttcgctggctagatcttttccaacagagcatgtgactctcatcattacagcagaggaatgcatttatcaaagttaaggaagtcgtttgccattcggatggcccaagaagcataaatatttatcattgagccttgtgagaactctctattataaaaagattggctaatttcttaaaactactccttcaataaggacccaggttatgtgccatggtatctgtagctttctggctgggtcagggtgacccgcacacaaccctggcaggacgcccttggacacagtatttgcatccctttggtgtgccaaggtatcaagcattcacagttcacattgaaaccactaaacgaagagctgtgcaaacaggtcatcagtttctccagaggggaataatcttacaactgttacgaagggtcaaaggtaactttcattttgagatgctaattactccaagaatttgatgcaggaggcagctggttaaaatgaatgagtgctgaagcgttgaaggggaaaatcaaatagatggttataataaaagtgcaatatgcaacctaataagtatgcagagaataagggacaatattgttaataaacatctattagtcaagatgatctttgtagagctgggctctttaatattataactgct

SEQ ID NO: 466858 - DNA, 1684 bp, Homo sapiens
ctgtggttcattaaggggtgaagttgggtatatccagcgttgttttaaataaaagtgaagaaaatggaaaatattagagtgtacgaggtggaggaccaggaatgggaaggaaaggccatcactgtgttctcatttcgcaatgtctcctcccagagccagactaggaagcaagtcctctgtgtggttgttcattgtgtttttaatatacatacaaaaccctgaatggtcaatttttgtgttgtagatggagacgagagatctggacttctgaacatctaccggaaaagataaaatgtgcaagcccttcagaacgctggggaggttgggctgaactgcagtgggagaggagaagagatgctggcgtgaagggctggggcagaagatcaggggaaaattgcggatgatctgaatgatagcagtgaccaccagcaacctacagagctgcccaaccaggaaattgtcagatggaagcaacgcttgcaggcaaagaaggctgaagcaggccaaggcaggaatgaaacagtcataaatgttggagtgaagcgactgacctccccggtccacaccccggcccagcgtcctgcatctgctggaggatggtggagaccatgtggaggatggggacttggcagtggaggagaacatggaagcaggatatggcagtcccctagcgtcccagccacaagtcctctgaagagtgtggatgacgatggtgacttaggtgcatccttcgaatgtcctgagggggagactggagaagcagacacgcaattgtgggaagaaatcaaaggcataaagaactcacagcacaagtccaaagtctgatcagcgagcaggcctctctgcagggtgcaagggcacagctggagagggagctcccgaagctacagccgacgcttcctgttctgcctgatctccaccgagaacacatgatggggcctcatgggagtccacagaggaggacgcctactgcctggaccttgagcagagacttcacaaggtgcacacatacatgaaccacatgtcacaacccacaaccactacaagaagatggcccaagacctggcccagaaattgaagaaagacacttccagttttcagagggagatcctctgccacaagagaacagcccaggaaagctagatggccgctgcgaccactgagatagaactccaggtgctgcagaaagaaaatgactacagcaggcagaagccggctgactgcaaggccaagttgcagcctttcctgaatgccaccattggcaacgggggctcagtggcgctaggagctctgcgaggtgctggagacctcacctgcgagtggttttacccacagagtaagggagctggggtgtttatccacaacttccttccatcattgtgcttccacaagtctgactctgccttgtcactgattgactttgccttccaaaatgagatgacatgtttattgtctaacatcatcactgattacgacaacaatcactcacaacaactggtgtggtcacacaacatctcaccccagatgggctttggcggctatgtctgtgataatgagaactcgaattttcctgttcagagtaaaggctctataagtttaaggaattggagcagtttaagagcagggacaaatggttaaccagttaaataagccaaacaaggtgtcagaagatcaaattctggtt

SEQ ID NO: 466859 - DNA, 1616 bp, Homo sapiens
caaacacaaagcccttccctcccctcctcctctttcctctcctctcccctcccctcccctcctttctcccccttcctcctcttgctcctcccgggcggggaaacccagccccgcgctcgtctttggggccaccggtcgcccccgcctccgggacctgcggggagggcccgcgagagatggagacgagagatctggacttctgaacatctaccggaaaagataaaatgtgcaagcccttcagaacgctggggaggttgggctgaactgcagtgggagaggagaagagatgctggcgtgaagggctggggcagaagatcaggggaaaattgcggatgatctgaatgatagcagtgaccaccagcaacctacagagctgcccaaccaggaaattgtcagatggaagcaacgcttgcaggcaaagaaggctgaagcaggccaaggcaggaatgaaacagtcataaatgttggagtgaagcgactgacctccccggtccacaccccggcccagcgtcctgcatctgctggaggatggtggagaccatgtggaggatggggacttggcagtggaggagaacatggaagcaggatatggcagtcccctagcgtcccagccacaagtcctctgaagagtgtggatgacgatggtgacttaggtgcatccttcgaatgtcctgagggggagactggagaagcagacacgcaattgtgggaagaaatcaaaggcataaagaactcacagcacaagtccaaagtctgatcagcgagcaggcctctctgcagggtgcaagggcacagctggagagggagctcccgaagctacagccgacgcttcctgttctgcctgatctccaccgagaacacatgatggggcctcatgggagtccacagaggaggacgcctactgcctggaccttgagcagagacttcacaaggtgcacacatacatgaaccacatgtcacaacccacaaccactacaagaagatggcccaagacctggcccagaaattgaagaaagacacttccagttttcagagggagatcctctgccacaagagaacagcccaggaaagctagatggccgctgcgaccactgagatagaactccaggtgctgcagaaagaaaatgactacagcaggcagaagccggctgactgcaaggccaagttgcagcctttcctgaatgccaccattggcaacgggggctcagtggcgctaggagctctgcgaggtgctggagacctcacctgcgagtggttttacccacagagtaagggagctggggtgtttatccacaacttccttccatcattgtgcttccacaagtctgactctgccttgtcactgattgactttgccttccaaaatgagatgacatgtttattgtctaacatcatcactgattacgacaacaatcactcacaacaactggtgtggtcacacaacatctcaccccagatgggctttggcggctatgtctgtgataatgagaactcgaattttcctgttcagagtaaaggctctataagtttaaggaattggagcagtttaagagcagggacaaatggttaaccagttaaataagccaaacaaggtgtcagaagatcaaattctggtt

SEQ ID NO: 466860 - DNA, 1331 bp, Homo sapiens
tggatagaatttctcccccttctcttgcactaggagtaagtgagcgtcactagaagcatccagatatgaaggcttcaaatcctacctaaactgcagaccaatctctgaaagcaactttgttcaattgcagcctgactaggaatttatacttttgaaaactcattgacttctggatttttaaaaaataatataaacatttaagaagctaccaaaatatgcgaagcctgaatagggaggtatcagaaccacaacaaatggaatgaaacctaccactaccacctgcctggcacaaagaaataatttacaattcacggggaatttcctgtgtttcattttgtctgaagaactgtaactggacttgaatgaactaagtgtctaattgttgcattatttttcttgtagagattttagtgttttattactttctccagtttacttcaatagtgaattaggttccctctaccatctgaaatgttacagttcgataaaataggtaaattaataaagtctaaagtgcttccaagctgagcagagacctttctggctgccataacaaagtaccatagaccgggaggcttaaacaacaggctaaaagtcagagatcaaggtgccagcagctttgggtctgaaggacacaggcgctgagagggagcgtctcaggtaaagaagaagaggggaagctgctggggggcggtggggggcgggggtaatgtgagtctgcagggccccaggatgccacagccccgccggagcagtccctggggaagcagcgtttcctgtccctcgtggcctcctctgctacccaggataggctgcatcctcctgcgcaatgcccaccatatgctggatgctctgcgggccatggaaaactccagcatttaacatggtgggtgtgatacccgacacagaaatcactattaaacaacaaatggcatttgtgaatattcaattgcaatgttgtaagaaggaacatgaaaggcaagatttggaaacaggtttggtttgggcaacctggaaggctcctggaggaagtaacattgaacaagcctctcacgcgggacttgcctgtaattacctccaatgtggaaagaaaaagaactttcacatcctgactctaaaattctctcttcgccccgtgtgtcagtacataaactttaattcagacattggcagtactgtcagcagctcatatgtcatcagcggagggctcggaggctccgcgtgccagggagcaggcggcttctattgccttcctggaggtcgggatccccctggtttgctgaaacctcaaaggcaagtctttctcgagggcgagaacagaacctgaaaga

SEQ ID NO: 466861 - DNA, 2064 bp, Homo sapiens
agtctgtgcctatgccttctagaacacgctctgatacccgataattcccttccaaaatgtcactaagttaattcacagggctctttttctgacaccaactcgatgaagcaggcactgtttattattccccaaacacaaagacacagggatctggagactggaagcactggcggctgcaagtggcagggctggcggggtgtgaagccggagaggagtctttctgcagtcaggcctcccaaatcccgggatggaatcaaggagcctttggctgtcccacccctcctcctccaagcccccaaatccaagtctgttatatcccgtcagctctgcgggcctgcctgtgactttcagcccaagggggcgggcacttcgtgtcacgccacgttgtccacatcatcgaccctccctccccttctccccttccttccttccctccctctcttcctcccattgagtgccagttctgtgccaagctttgctgttcaaaatgttacgagtggagaagtcagggaaggatggaattataggtgtttcttcttcatacctttctgtttggctgattttttttcaaatgagcacgcaggcccggttcctcaaacccacttccaatgtggcattgctgggttggtttggtccaaggaaagccctgtctccttaactcccagcccccacgcctcctccgccggcccccaaatccaggccgccctgccccctccggaaaggggagttgggggcgagcgccgaaatctgagtggctctttcaagcctccgttgccatagaaaccggccgcacaggccgatgctgtccattacaccatcctctagcctcgcagccaatggactccgagctccatcgccagaggccccgccccccagctctggggagtccaccaatcagcaggtcccgtgacttagagccctgccctcggcccagggacaccaccaatgcgcttcgaccctgccctccttctcttcggtgtaacaagaagactcgatatttttttttttttttttaggaattctccagatcagaaggaattggcagtaaggcctctgtcagctgcaccctgaataatctttggctgctattttatttaaggagagcaaaactgtttcaattacgcaacaatatataccattctctactaaaacaattttaggaaatgaaaatacgcatggtatatttgttccaattaataattttttaatgatacattatttattaattagagttcacagtttattcagatttccttcgtttttacccaacgttctttttctactccatctttttctactccaggatccatccagcatgcctcatcgcactagctgtcgtgtctctctgggctcctcttggctgtggcggtttctcacatagcaacatgacatcactgttggtgctgcgtcaggtttctctactggaaaagataaggtcttgccatgttgcccagactgatacaactcccggcctcaagccatcctcctgccttggcctcccaaagtgttgggattacaggcgtgagccaccacacctggccttggggtatcatttcttttaagccttctcaactgacagaacaaagaaatatatctgtatataccaatgtgtatatatatacacacatatctatatttccatttgtaaccatctgtatatatattaagctaaacatgagttcctgtttatatttaccacttgaatccagggatcatttggcttgcttcctgcttgcttatctctaaattcccactccaataacgggaaacctggttcccatcatccacatccaccatccatttacttaattgttcaagtccagtatacatgtgtaggattatcaaaattgttaacccatacccctgtgggaaactttatcaagtagagtacattcttctgaacactttcttttgcctttagtgttccagcagactccacttgtttcttttttctttttcttttttttttttttttgagacagagcctcactctgttgcccaggttggagtgctggagtgcagcggggccatcacagctcacagcagccttgacttcccagtctt

SEQ ID NO: 466862 - DNA, 1539 bp, Homo sapiens
agtctgtgcctatgccttctagaacacgctctgatacccgataattcccttccaaaatgtcactaagttaattcacagggctctttttctgacaccaactcgatgaagcaggcactgtttattattccccaaacacaaagacacagggatctggagactggaagcactggcggctgcaagtggcagggctggcggggtgtgaagccggagaggagtctttctgcagtcaggcctcccaaatcccgggatggaatcaaggagcctttggctgtcccacccctcctcctccaagcccccaaatccaagtctgttatatcccgtcagctctgcgggcctgcctgtgactttcagcccaagggggcgggcacttcgtgtcacgccacgttgtccacatcatcgaccctccctccccttctccccttccttccttccctccctctcttcctcccattgagtgccagttctgtgccaagctttgctgttcaaaatgttacgagtggagaagtcagggaaggatggaattataggtgtttcttcttcatacctttctgtttggctgattttttttcaaatgagcacgcaggcccggttcctcaaacccacttccaatgtggcattgctgggttggtttggtccaaggaaagccctgtctccttaactcccagcccccacgcctcctccgccggcccccaaatccaggccgccctgccccctccggaaaggggagttgggggcgagcgccgaaatctgagtggctctttcaagcctccgttgccatagaaaccggccgcacaggccgatgctgtccattacaccatcctctagcctcgcagccaatggactccgagctccatcgccagaggccccgccccccagctctggggagtccaccaatcagcaggtcccgtgacttagagccctgccctcggcccagggacaccaccaatgcgcttcgaccctgccctccttctcttcggtgtaacaagaagactcgatatttttttttttttttttaggaattctccagatcagaaggaattggcagtaaggcctctgtcagctgcaccctgaataatctttggctgctattttatttaaggagagcaaaactgtttcaattacgcaacaatatataccattctctactaaaacaattttaggaaatgaaaatacgcatggtatatttgttccaattaataattttttaatgatacattatttattaattagagttcacagtttattcagatttccttcgtttttacccaacgttctttttctactccatctttttctactccaggatccatccagcatgcctcatcgcactagctgtcgtgtctctctgggctcctcttggctgtggcggtttctcacatagcaacatgacatcactgttggtgctgcgtcaggtttctctactggaaagtcagtcttcttttgccccttttcatactgtactctttggaaggaagtcactatgctcgggccacacttaagtgaggagttatgctctatctccttaaggttggaatagct

SEQ ID NO: 466863 - DNA, 1687 bp, Homo sapiens
aggggttggaggaagggtaggggacgcgagcctgcttccatctgacgctggacgcttgtccctgccccgcgttgccttttaaattttagctcattccgagacacctgccgtcagacatttatgcagtgtgtgattctttctaaaacaactccctggaagagaggacatttaattcaacaatttattggccacctactgtgcaccaggcagtgaacttggaactggggctactgggttacagcagtgaccaagacagaggtccctgttcttaaggagcaagtgagggcaacagaaaagagcagtcagctgtcatgcgagggcactcaagcagccctgtggaaagctctacgtggtgagaaactgaagcctcctgccaacaccaacaaggaactgagacctacttccaacagccatctgagtgatcgatccatcctggaatcagatcctccagccccagtcaagtcttcagatgactgcagccctgaccagcatctcaactgcaacctcgtgaatgaccctgagccagaaccatgcaactaaactctgcgtggattcatgacccacagaaactgtgagatggtagctgtttgctttgttaagcctctaagtctggaaagaatgtcttaagcagtagcagacaatgaacacaagattattattcagctgttgaattggaagaggaggggaagaaaaaattttcagatcacaaaatattcattgtgtaaaacttcaaaaattctgaaatttaaggaaaaaatatcatttgttgggaatttgttgggattcattgtctcagtgccaagagacacccactctttttttttttttgagacagagtcctgctctgttgcccaggctgaagggcagtggcacgatctcagctcaccacaacctctgcctcccgggttcaagtgattctcctccctaagcctcccaagtggctgggactacaggcatgcatcaccatgcccggctaatttttgtatttttagtagagacggggtttcactatgttggccggctgatctcaaactcttgaccccgtgatccgcccgcatcagcctcccaaagtgccgggattacaggcatgagccactgcgcccggccgagacactcactcttaacattttggtatattttttctctctgcacattttttatccagctgactttattttgtctcctgaaatcttcatttttaaattatagcttcagcatttaagaaaatgtgtctaacaaagtcttcgcaagcatacatttttcccatagttagtatacttagaatttatttgtcaagcaattttgaagggctttcactatgaaaaactttagggcttattgatattctctttaagtagaagtatgttttttattattacaaaagttatatatgtatatatatggtgtttgtgtttgtgtgtgtgtgtgtgtgtgtgtgtgtgtgtgtgtggagtctcgctctgtcaccaggctggagtgcagtggcgtgatctcagctcactgcaacttcctcctcccaggttcaagcgattctcctgcctcagcctcctgagtagctggaactacagaacattaaaaaaaaaaaaaaacagctttgttgagatgtaattcacataccacactattcagtcatttatagtttacaattcagtggctttcagtgcattcacagagttgtgtaactgtt

SEQ ID NO: 466864 - DNA, 1698 bp, Homo sapiens
gcggagggtgcggccagcgcggtacccgccccggcgaggcgctggggaggcccgggtggggagaagaaatggggcctgggggacggtaggagcctccgtgcggagaccactgttcaaggccacagacatttatgcagtgtgtgattctttctaaaacaactccctggaagagaggacatttaattcaacaatttattggccacctactgtgcaccaggcagtgaacttggaactggggctactgggttacagcagtgaccaagacagaggtccctgttcttaaggagcaagtgagggcaacagaaaagagcagtcagctgtcatgcgagggcactcaagcagccctgtggaaagctctacgtggtgagaaactgaagcctcctgccaacaccaacaaggaactgagacctacttccaacagccatctgagtgatcgatccatcctggaatcagatcctccagccccagtcaagtcttcagatgactgcagccctgaccagcatctcaactgcaacctcgtgaatgaccctgagccagaaccatgcaactaaactctgcgtggattcatgacccacagaaactgtgagatggtagctgtttgctttgttaagcctctaagtctggaaagaatgtcttaagcagtagcagacaatgaacacaagattattattcagctgttgaattggaagaggaggggaagaaaaaattttcagatcacaaaatattcattgtgtaaaacttcaaaaattctgaaatttaaggaaaaaatatcatttgttgggaatttgttgggattcattgtctcagtgccaagagacacccactctttttttttttttgagacagagtcctgctctgttgcccaggctgaagggcagtggcacgatctcagctcaccacaacctctgcctcccgggttcaagtgattctcctccctaagcctcccaagtggctgggactacaggcatgcatcaccatgcccggctaatttttgtatttttagtagagacggggtttcactatgttggccggctgatctcaaactcttgaccccgtgatccgcccgcatcagcctcccaaagtgccgggattacaggcatgagccactgcgcccggccgagacactcactcttaacattttggtatattttttctctctgcacattttttatccagctgactttattttgtctcctgaaatcttcatttttaaattatagcttcagcatttaagaaaatgtgtctaacaaagtcttcgcaagcatacatttttcccatagttagtatacttagaatttatttgtcaagcaattttgaagggctttcactatgaaaaactttagggcttattgatattctctttaagtagaagtatgttttttattattacaaaagttatatatgtatatatatggtgtttgtgtttgtgtgtgtgtgtgtgtgtgtgtgtgtgtgtgtgtggagtctcgctctgtcaccaggctggagtgcagtggcgtgatctcagctcactgcaacttcctcctcccaggttcaagcgattctcctgcctcagcctcctgagtagctggaactacagaacattaaaaaaaaaaaaaaacagctttgttgagatgtaattcacataccacactattcagtcatttatagtttacaattcagtggctttcagtgcattcacagagttgtgtaactgtt

SEQ ID NO: 466865 - DNA, 2084 bp, Homo sapiens
ggagggagaagggaatatgataatatgatgcccagtttccaaataggaagcaccgaggacacgcagactaggattcgattcccaggctcgcggtcccagctgtctctcccctgctcagcaccaagggccgcggggcacctcgcctgccagccaaaggtcctgagctgggcggacttcccgcttttcacaaaccgcaggcgacattcgaggatgccctgcccggtgcccgacttgggcgcgtcgccccacccaagcctggagaagcgtgcaggggcacggggcggagccagtcctgggggcgtggccgggtggccggcacgaggcgcgtggcggggaggggccgcgcgctcccggctcaccacgtgtgagccagttcgggcaccactgggcgtgtgccgcccctgggggaggtcaccttcacggcgtcgtgagcatgggcgatgggagggggcgctgaggcctcgcccttgggaagcaggagctgggaggtgcccggattagggtctttaagacatttatgcagtgtgtgattctttctaaaacaactccctggaagagaggacatttaattcaacaatttattggccacctactgtgcaccaggcagtgaacttggaactggggctactgggttacagcagtgaccaagacagaggtccctgttcttaaggagcaagtgagggcaacagaaaagagcagtcagctgtcatgcgagggcactcaagcagccctgtggaaagctctacgtggtgagaaactgaagcctcctgccaacaccaacaaggaactgagacctacttccaacagccatctgagtgatcgatccatcctggaatcagatcctccagccccagtcaagtcttcagatgactgcagccctgaccagcatctcaactgcaacctcgtgaatgaccctgagccagaaccatgcaactaaactctgcgtggattcatgacccacagaaactgtgagatggtagctgtttgctttgttaagcctctaagtctggaaagaatgtcttaagcagtagcagacaatgaacacaagattattattcagctgttgaattggaagaggaggggaagaaaaaattttcagatcacaaaatattcattgtgtaaaacttcaaaaattctgaaatttaaggaaaaaatatcatttgttgggaatttgttgggattcattgtctcagtgccaagagacacccactctttttttttttttgagacagagtcctgctctgttgcccaggctgaagggcagtggcacgatctcagctcaccacaacctctgcctcccgggttcaagtgattctcctccctaagcctcccaagtggctgggactacaggcatgcatcaccatgcccggctaatttttgtatttttagtagagacggggtttcactatgttggccggctgatctcaaactcttgaccccgtgatccgcccgcatcagcctcccaaagtgccgggattacaggcatgagccactgcgcccggccgagacactcactcttaacattttggtatattttttctctctgcacattttttatccagctgactttattttgtctcctgaaatcttcatttttaaattatagcttcagcatttaagaaaatgtgtctaacaaagtcttcgcaagcatacatttttcccatagttagtatacttagaatttatttgtcaagcaattttgaagggctttcactatgaaaaactttagggcttattgatattctctttaagtagaagtatgttttttattattacaaaagttatatatgtatatatatggtgtttgtgtttgtgtgtgtgtgtgtgtgtgtgtgtgtgtgtgtgtggagtctcgctctgtcaccaggctggagtgcagtggcgtgatctcagctcactgcaacttcctcctcccaggttcaagcgattctcctgcctcagcctcctgagtagctggaactacagaacattaaaaaaaaaaaaaaacagctttgttgagatgtaattcacataccacactattcagtcatttatagtttacaattcagtggctttcagtgcattcacagagttgtgtaactgtt

SEQ ID NO: 466866 - DNA, 941 bp, Homo sapiens
tgtcgtcatgtctggcgtggggcatgctggtgcacaaagagccgaaccaagctccacagcaggaactgacaccaagccaggccccaaggaggcctggctgcccaagtggcaggccacaaaccacgcatcgcctgacccaggctggggcagcagcgtctcggagaaaaacaggaaattgggacatacgcgctttccaccgcctggctacctagtatctggaaacatctactggacatgttggactcattttctcaagaatccactttacccttcagggaagccaggaaaagaacaagcttccaaccggtacaagtctggaggaatttcacagcctctcaaactacgcttcagtgcctacccacccctgcagctgaaccactttgaatattccttgatggtgcaagagacagtctcactattcccttcactggccttcctctgtgtccgagtccccggcgtgcagtggagcctcgctgggggaaatgacagcttggaccatgggcgcccgcggtctggacaagcgaggaagtttctttaagagaataacagaagagctctctgacaccacaaagactagacctgcgactagctttgaagaaactacattgctgaaatctggctataccgaatagatgaaccagtgggtgatgattcacttgacctcagctgagttccctcaactattggtctcttcttggcatttgaaaaagtattcaattttcaaaaattctgtctgccaagcaaaatttttcaatcattcagaactggtccaactgcacatctcaggcctcagggattcccagtaatggagttttcagatttttttgtttccagataagtggaaattcattcatctgcatgcacagtaacaatgtactgtggacagagattgcaggggcatgaaaaataatggatagaatcaaaaaccacattttagtcag

SEQ ID NO: 466867 - DNA, 605 bp, Homo sapiens
  misc_feature (19)..(19): n is a, c, g, or t
  misc_feature (32)..(32): n is a, c, g, or t
ggagacactctaacgccantaaattgggctantaacccgatcccattctttacccaggtatctgcagatttatggctaaaagaccaggaccccctggaagccgagaaatggagtccccggcgtgcagtggagcctcgctgggggaaatgacagcttggaccatgggcgcccgcggtctggacaagcgaggaagtttctttaagagaataacagaagagctctctgacaccacaaagactagacctgcgactagctttgaagaaactacattgctgaaatctggctataccgaatagatgaaccagtgggtgatgattcacttgacctcagctgagttccctcaactattggtctcttcttggcatttgaaaaagtattcaattttcaaaaattctgtctgccaagcaaaatttttcaatcattcagaactggtccaactgcacatctcaggcctcagggattcccagtaatggagttttcagatttttttgtttccagataagtggaaattcattcatctgcatgcacagtaacaatgtactgtggacagagattgcaggggcatgaaaaataatggatagaatcaaaaaccacattttagtcag

SEQ ID NO: 466868 - DNA, 625 bp, Homo sapiens
tgttttagcttacagggatcctaccctcccgggcctcaaaaccactcatgctgcagaaggatccctgaacctaggttcacgaaccaaccggggtcattcaaaggcccagcccagcagcagaggcccaacttgagaggccctctttggtcatgtctcacaggttggataagaaggtgcatcacgattgtgtttcagaaacagaaaacctgtcattatatttcagagaataacagaagagctctctgacaccacaaagactagacctgcgactagctttgaagaaactacattgctgaaatctggctataccgaatagatgaaccagtgggtgatgattcacttgacctcagctgagttccctcaactattggtctcttcttggcatttgaaaaagtattcaattttcaaaaattctgtctgccaagcaaaatttttcaatcattcagaactggtccaactgcacatctcaggcctcagggattcccagtaatggagttttcagatttttttgtttccagataagtggaaattcattcatctgcatgcacagtaacaatgtactgtggacagagattgcaggggcatgaaaaataatggatagaatcaaaaaccacattttagtcag

SEQ ID NO: 466869 - DNA, 2308 bp, Homo sapiens
tctgagcagatgagggtatgaactgacttaggttccctgaatgtgaccttggctgctgtatgaaggacgggcagccatttcctcatctgatagcaaactggtatggaccagagaaacgagaagcttcccactgccactctaagagctgagattccgagtcatatcaagcttcctgatgcaaaggaacaccggagcggggcgattgcctccctagagctgggccggccacccccacccctcgggctgctaaagcagcgggccgggcggaaggtcggggagccagagcccagggaagagcagaaggcgcgggggggcggggggggcacccaggagggaggacggggcagcgggctggtgacagcaccacccccgcgccgcctgcaatctgccaccgctgccaccgagccgaggggcgccagcaaggcatcccctgggtcaaggggcctcccgtgggctttccaaacagcctgtgctcatttccgcgggagccctcggggcgctgtgctgtggctgcattattaactcagtctcatttgggcaaataattaatcactttttattcaaatgctctagaaggattgttatctcttccttctcagtggatctcacaacctgatctttccttctaatacagtgtttgggaacaggtagaagtttatgttcttacctacatattgttctctgctggctcccagtgacctcaagttcagatataccctaccagggaaaactctaattttgctgcatctattgctgatgggtcttgtgtaatttatagtctgtccttgctgaattgtctttctttgggggtcttggtgttgaaattcctcctctgggacatggcaatgattcccattcaacctagagcctgagtgacccaccctacaggcctcttctacaaaatcaccacattctttactgagagtcctttggtggagtcataagtcagtttcctggggcatgcaggaaagtgaattctctgtaaagcattctcaggctaaggcaggcgaaataagctttcttggtatttaacactatcatgtgttcatttcttttcttttttgacatctccctgttggcataggactcatcttaaggtctttaaatgttctaggatctgctggtaaaagtgaggaataattttccctgttctggcattcctccaaaactgtctggttatttctcccactgtatcatcttggatgcttttggctctaaataacagaaaccctgactcaaactggattaaacaagaaagaacgtcattatagcacaaaatgaaaagtctagcattaggtttggttaattcaggggctcagcaatgtcagctgggacatgggttatttccatctcttcactatgaaatccacactgttgacttcattccaaagctgacttttctgcatagccagaagttggctgtaaatagtacagtaatacccccctatccaaaagggaattgttccaagacctctagtggatgcctaaaactgctgatagtaccaaatgctatatatactatctttgttcctatccatatatactatgataaagtttaatttataaattaggtaccataaagattaacaaccgtaagtaaaatatgggttagttgaacacaagcactataatactacaacagtcaatctggtagccgagaggactaaatgactaatgtgtggtagcatgtacaatatggatatggtgcacaatttaaaacttgtgaattgtttatttctcaaaatttccatggaatagtttcagactgtggttgaccataggtaaccgagatgcagaaatcaaaataaaatcatggagacggggggaatgactactgtatggagagcctgcttcctccatcaccaatgggaaagaaaaatagaaaacttctctgtaaccttgtatttaaaaacttttcctccatcttcattgggtcatctcagaacaagtaagaatggacagaggaataccatgtgctgactgacgaacgcctgggtttctgaaccaattgccatcaaggggattgggattaccataatttttgctgagactaagccccaccccagtaaccaaaggcttatgggtggaatgcaagctattggaagtatttgaagatgtgaccaaggaagctatgagaattggaaatgaggcagttgtttagaaacgggctgatgtgcttgtggtaaggtggaaggaggaaggcagatgaggaaaggaatgtgcaactgaagcaattagctgttactatgtaacgaaccatcccaaaacgtagtgacataaaacaacaaccatttgttatttctcatgc

SEQ ID NO: 466870 - DNA, 1012 bp, Homo sapiens
tctgagcagatgagggtatgaactgacttaggttccctgaatgtgaccttggctgctgtatgaaggacgggcagccatttcctcatctgatagcaaactggtatggaccagagaaacgagaagcttcccactgccactctaagagctgagattccgagtcatatcaagcttcctgatgcaaaggaacaccggagcggggcgattgcctccctagagctgggccggccacccccacccctcgggctgctaaagcagcgggccgggcggaaggtcggggagccagagcccagggaagagcagaaggcgcgggggggcggggggggcacccaggagggaggacggggcagcgggctggtgacagcaccacccccgcgccgcctgcaatctgccaccgctgccaccgagccgaggggcgccagcaaggcatcccctgggtcaaggggcctcccgtgggctttccaaacagcctgtgctcatttccgcgggagccctcggggcgctgtgctgtggctgcattattaactcagtctcatttgggcaaataattaatcactttttattcaaatgctctagaaggattgttatctcttccttctcagtggatctcacaacctgatctttccttctaatacagtgtttgggaacagaacaagtaagaatggacagaggaataccatgtgctgactgacgaacgcctgggtttctgaaccaattgccatcaaggggattgggattaccataatttttgctgagactaagccccaccccagtaaccaaaggcttatgggtggaatgcaagctattggaagtatttgaagatgtgaccaaggaagctatgagaattggaaatgaggcagttgtttagaaacgggctgatgtgcttgtggtaaggtggaaggaggaaggcagatgaggaaaggaatgtgcaactgaagcaattagctgttactatgtaacgaaccatcccaaaacgtagtgacataaaacaacaaccatttgttatttctcatgc

SEQ ID NO: 466871 - DNA, 901 bp, Homo sapiens
agagagaagatggaaagaaggaagggagcgaggaagaaaagaaacaagaaaggaaggaagaagaaaagaaaagaaagagagaagaaagaaaaagaaagagagcgacagaaagagagagagagagaaagacagacaaaggagggagaaagggagggacaaagagaagaaggaaggaaagaaagaaggaaccaaggaagaaaggaaagaagaaaggaaggaaggagaaaaaagaaaaaagaaggaaggaaggaagaaaggaagcaagaaagaaagaaaggaagggagggaaagaaaggagggagggagggagagaagggaggaaggaaggaagcaaggaggaggggagggagggaagagaagagggagggaggaccagacatgagcagatattactggatcttggacaagtgggtctctaaggaacatcaaagaccctgagaagccaaaagttatgaaatgcatcagcagtgggttgaagacaagacctctccttttcctgctgacatttcttccatgagcagtacccagacagccgacagaaagagcccaggagatcaatggtggtgttggatcaaaattgtagctcacaaggaaaatcctgtaaaggaaccatatttttctgtgttgcctgccaaaatgagaacatcatttgttaaataatgtgggacacaggtgccccggatgtactatttaatggagaaagaaaaagagagaaacaatggctgccagtatccgggaaaaatgcgactagcttcttaagcttcttcacccagaaattgttacaaatagaagggaatctgactttgagctatgagttgttgcttccccatgactgaattccccaagaactgagttattactgacctgtgatttgctcatcataaggtctcactgttaatta

SEQ ID NO: 466872 - DNA, 3207 bp, Homo sapiens
agagagaagatggaaagaaggaagggagcgaggaagaaaagaaacaagaaaggaaggaagaagaaaagaaaagaaagagagaagaaagaaaaagaaagagagcgacagaaagagagagagagagaaagacagacaaaggagggagaaagggagggacaaagagaagaaggaaggaaagaaagaaggaaccaaggaagaaaggaaagaagaaaggaaggaaggagaaaaaagaaaaaagaaggaaggaaggaagaaaggaagcaagaaagaaagaaaggaagggagggaaagaaaggagggagggagggagagaagggaggaaggaaggaagcaaggaggaggggagggagggaagagaagagggagggaggaccagacatgagcagatattactggatcttggacaagtgggtctctaaggaacatcaaagaccctgagaagccaaaagttatgaaatgcatcagcagtgggttgaagacaagacctctccttttcctgctgacatttcttccatgagcagtacccagacagccgacagaaagagcccaggaggtaactggggacatgagatgaaaactcaagatgcaagggtatcccatcttttggcttccttgggccacattggaagaagaagaattatcttgggccatgcaggaaatacactaacaataactgatgagctaaaaaaaatcaccaaaaaatctgataatgttttaagaaagtttacaaatttgtgttaggccacattcaaagcaatcctgggctgcctgtggcctatgggccacgggctggacacgcttgcaagggagaggacagataaagatacgtatgagagcatcctccttagagaaaggtcagtgttgaagtcatagggtaagggaactctttcaaaagaaagtaaaaaaaaaaaaaaaagatagcgaagtaaatcatgtgaagtctctacagagtaagggccaaagggaggacacagtagcttaaaatcacaatattgtttttgttcctatttttgtttttctcataaagctacaggtcagctggacagctcgctcttgggtcctcacaaagctactggtcagctgggcagctcagctgggtcctcatcaatgaaccagggttggctgattttagctgggctcactcaattttctagagtccactggtctgtctgctgcagtgtggctgatctaggacagccctggccttggtgacctggctctgctgcacgatgcagccatcctctagcaggctagcctatcacagcaaaacagaagcacaaaagagagatcaggaaaacgcatagcttcttaaggcctaggccctaaactggtgcatcacttacttcttggcaacattctggtggccaaaggaagtcacatgtccaaccccagactctaaaggagggaaaagagacccgatgccttaatgggagtaaagtcacattgcaaaaggcaaggatcccaaaaatgtttcaaaaaaaattggaggccatctttgcaatcaaagttagattattctcaatggtaaaagttggaaccacaatattattgttaccttcaaagagtacacctagctgaatcccccagtcaatgcaggaattcccccaaattaaacacacacacacacacacacacatacacataaaccctcaaagattcccacaacttgaccatttgacctagcttttctcactgggtaaaaaaagcaagagggaaaaaaaaaccactgcagctctctcccacccctgctgttcagccttcagtttatctggcctctgctatgagtcacagctgactgaagggtgggggtgggttgtgagtcatggcctaaaacaaagatagaatttgatgggggtggacgagcaggcgagagagaagacacggcaagttcaggcattctctcagtgtttagggtgatgtcttctttcctgcagctggggaagttgggcagagtgcccccgaaggaggagattccacacaggccctgtgtatctgagagttgagttgctgatttcagaggtgtttgtatcattgctctaaatgtgtttctgctcccctcccacccaagatgctggttcaacggaccatttcatcctaccattatacagaacccacaggagctagttacctggtcagtttgagaagttaatatttaaaaagactaatggttgcatatggcttccacaggaaagaaataataagctaatgttatctattgactcaatcccacatatatttacatttgacaacttaaaaaaaaaaccttcggctcaatgatagtttagctcaagtcactatgttaggatatatatttctttcatctatgactatttttgtctgcacagtaacctgcctcaagcacacaaatatttgtgtgtctggcctcaagcaattaacgtgtctcctaacatgagataaagattaaatgaaaattctgtcaccctgaaataaacctggaagcagaattcctgaatgtttgccaaataaggtgactatcagacttaagatgctgaactttgaaatgactgtcatagaaacaaaggcaaggcatggttggcgcccattcaacctggtcaataacatccttaattacaggacatggcatcattttgattcacagtggaataaaaggcatctatttgtatatttggaagtctgaatgaggatttcctgatgaagtcatttctgtcttacaacagcttcgcttgtaccagtagagttaaaactgggtcaccatttttatgcgagcgtatggatacacatacatccacactcgaaccccaaacacacacacacacacacacacacacttcatttcagagtctaattaaaactctattatacataattttcttccagatcaatggtggtgttggatcaaaattgtagctcacaaggaaaatcctgtaaaggaaccatatttttctgtgttgcctgccaaaatgagaacatcatttgttaaataatgtgggacacaggtgccccggatgtactatttaatggagaaagaaaaagagagaaacaatggctgccagtatccgggaaaaatgcgactagcttcttaagcttcttcacccagaaattgttacaaatagaagggaatctgactttgagctatgagttgttgcttccccatgactgaattccccaagaactgagttattactgacctgtgatttgctcatcataaggtctcactgttaatta

SEQ ID NO: 466873 - DNA, 416 bp, Homo sapiens
gccttgagccagctctggaagctctgctgtgagtggttaaggcctgagattcacaccaaggagcagatgttagacttgctgttgcttgagctgttcctggccattctgcccgaggagctcctggcctggatgcatgagtatcatccaaagaatggagaggaggcagtggttttgctggaggtaagaaagggtcctatacacttgggtagaacagcctggagagggtgtccaagctggtcctttgtgggatctctggggatcatgtacactgtcgccccttcagatgcccaaatgagcctgcttgtcctcaggtttcagcccaggcccatgtgcaggaagtgctttcttttttttcttttttttttattttttttttttttaggaggagaaaagagttttcatttggccccccgagg

SEQ ID NO: 466874 - DNA, 1151 bp, Homo sapiens
gccttgagccagctctggaagctctgctgtgagtggttaaggcctgagattcacaccaaggagcagatgttagacttgctgttgcttgagctgttcctggccattctgcccgaggagctcctggcctggatgcatgagtatcatccaaagaatggagaggaggcagtggttttgctggagattatgttatcagaatcaataaaatagaactgattcaagggcaggaacttactgtagatatggaatcccaagaaaagttacctggaaaatcaatgaaaggcttctgaatgagaagaaacccaagaacatgaaagatggacagaaatatatcagagagccgagtgcagtggctcacacttagaatcccaccactccaggtggagatgggcggatcacctgaggtcaggagtttgagaccagactagccaacatggtgaaaccccgtctctactaaaaatacaaaaattagccaggtgtggtggtgtaagcctgtaatcccagctacttgggaggctgagaggagaatcccttgaacctgggagcctcaggttgcactgagccaagatcacgtcactgcactccagcctgggcgacagagcgagactccgtcttatacaaacaaacaaacaaaaaacaaagaaatatatcagagaaacacaatcaactgagagaaaatatatgtgtgatgaatgtgggaaaacattcactcaaaactcaagccccattagacataaaataatctgtactggtaacacaccctcttcatgtaatgtatgtagcaaaacttttactcagagctcacaacttactgaccatcagagaatacatagccatataaaaccctatcagtgtgatgagtgtgaaaaaaaaatccacagtggaaagaaactatatgaatgtgacaagcgtggaaaggccttcagatacagttcagctcttgttggacaccagcgaatccacggtagagagaagccctatgagtgtgatgtgtgtgggaaagctttcagtaacagctcacatcttttgagacaccaaagaacccacactggagaaaagccctgcaaatgtgatgcatatggaaaagctttcaggcagagctcacacctcattttacatgagcaaatccacactggaaagaagccccggtgatg

SEQ ID NO: 466875 - DNA, 1257 bp, Homo sapiens
atttgcacatgtgaaactcaggagagaaatctggactttaaaattactttgttactatttttcttttcctctttttttccttttgaaacagggtcttgctctatcacccaggctgaagtgcagtagtgtgatcccacctcactgctgcctcagcttcctgggctcaagtgatcctcccatctcagcctcccaaatagctggttttacaggtgtgcaccactatgcctgctaatttcttattttttgtagagacaaggtcttactatgttatccaggctggtctccatttcccctgctcaagcgatcctcccgccttatcctacctaagtgctggaattataggcatgagccaccgggttaggctatttttctattttaacaatgatttctccctcctgagtaatagtcctgaaattttttattcctgaaatttaattcatgttaggttcaagatgtgccaaatcgatagaaattgcagatagctttggtggttcacatttggaatagattatagagaacactctctgggaaggtgaaatggtgttcacttctcagaaagaggctctgtgttgcaaagggatgcacagtttccgtgaattatcctaatcagcacttcaggcaagtcagctgtaaaacacactggacttcatgaagctctgagccaacttgtggccagtaggcactaaggtcagagacacatatggaaaagcacatgatgaagcctctggtattggagtagtgcctacagccctgcccaaggcctggatatggggattgaaggcaaagaagatcatggttctggagctcacgttgaggaaatggacctcactcagggaatggggcacattagagaaggtaaaacacatactgtacttacagcagaagtgaagggcttcaggaagttctctttgctttgctgagttcatgtgtgaattcttttgcactgcttcttcctgtctttggcaattgaaggagactaggttttccttgatttgacctgtcaccccatttctgtgctgttaccttcaatgtttttagtgtttacctttctaaccccagctatcttggtttgtttctagaatggagatttacagacagtcatctgggtggaggacacccttttgggatcagcactgaaagtgacgccatatcccactccaaaccagcacaactataaatactaagcagtgagtggtattctgaagactttgaaggaggagctatttctgaaaataaatttattttgttgaagaattt

SEQ ID NO: 466876 - DNA, 1900 bp, Homo sapiens
atttgcacatgtgaaactcaggagagaaatctggactttaaaattactttgttactatttttcttttcctctttttttccttttgaaacagggtcttgctctatcacccaggctgaagtgcagtagtgtgatcccacctcactgctgcctcagcttcctgggctcaagtgatcctcccatctcagcctcccaaatagctggttttacaggtgtgcaccactatgcctgctaatttcttattttttgtagagacaaggtcttactatgttatccaggctggtctccatttcccctgctcaagcgatcctcccgccttatcctacctaagtgctggaattataggcatgagccaccgggttaggctatttttctattttaacaatgatttctccctcctgagtaatagtcctgaaattttttattcctgaaatttaattcatgttaggttcaagatgtgccaaatcgatagaaattgcagatagctttggtggttcacatttggaatagattatagagaacactctctgggaaggtgaaatggtgttcacttctcagaaagaggctctgtgttgcaaagggatgcacagtttccgtgaattatcctaatcagcacttcaggcaagtcagctgtaaaacacactggacttcatgaagctctgagccaacttgtggccagtaggcactaaggtcagagacacatatggaaaagcacatgatgaagcctctggtattggagtagtgcctacagccctgcccaaggcctggatatggggattgaaggcaaagaagatcatggttctggagctcacgttgaggaaatggacctcactcagggaatggggcacattagagaaggtaaaacacatactgtacttacagcagaagtgaagggcttcaggaagttctctttgctttgctgagttcatgtgtgaattcttttgcactgcttcttcctgtctttggcaattgaaggagactaggttttccttgatttgacctgtcaccccatttctgtgctgttaccttcaatgtttttagtgtttacctttctaaccccagctatcttggtttgtttctagaatggagatttacagacagtcatctgggtggaggacacccttttgggatcagcactgaaagtgacgccatatcccactccaaaccagcacaactataaatactaagcagtgagtggtattctgaagactttgaaggaggagctatttctgaaaataaatttattttgttgaagaatttaaccattaagcgatcaggatatgtgtactgtggttattacttttgagctcaaagtaaggtattagtgattatttgttttaggttgggtcttgtgccgggtgctaggaatacaaaaataagtgaaaaaagcaccctaatctcgaggctcgcagactatttggtgacagggagaagagagtagatagaaaacaacaaatactgtgataaagccgctggatttgtagagtactttgcattgaagagggtttaacaatgactcacgaaaacaattgaaaaggctttggaggaggacgaaagcttggaggaaaagaatgagttcttgagccacatgatacagaagaatgagggaagggatccttgtcacaggatttagggcccacctggatattccaggctgatctcatcttgagatcataaacttagtaattacctgccaagacccttttttcaaataaggtccctcagaaagttatggaatgttaattctagcctctaaatctatagtttctcaggaagaattgctgatagtgtattcttttttaaagaacttttaatcaaatgagttaagtgtaaatgtttccttaagttagaatatcaaaataattcataggaattggagctgaaatcacttttctaattatat

SEQ ID NO: 466877 - DNA, 1627 bp, Homo sapiens
ccgccccgaggcgaggcctcggagctggttgctgctcacaggcagagaaacgctgaagtgttcctgaaaactcgtcaattacaggaaaagctgcatgactgcatctttagaggagatggtttcgctggttccaaggattctgttaatgagaaaactccacaggccagcattctgtaagctggctccagcagcccagttgacagtggctgaggccagttcctgatcatcctgaggaacaccagtcaactcacaaatccctgagagggaagcctccaggatcctagagtagatgaccagatgcccaggcgcaggatccacggaagtcaaagtcaagctttctaggccgacagctgtcctcagtcgcttggtcagatagtctaatctcagtttttcaggaatcaaggccagaggtgtgaacaaggtgtcagctctgaagggaaggtttttctaaggatggacccacaccagaaggtccctagcatatataatggggatactttacaaactcctgagtatgaaaaagtctctcagtatgaggaccagttagaaaggcatgagggtaggcacatggaagaaagacggtataaatgcaatgaatgtggaaagaagtttgcccagagctcaggccttgttcgacatcagagaatccacactggagagaaaccctatgagtgtgatcactatggaaaagcctttagcgtgcgctcaaccctcactgtgcatgaaagaatccacactggtgagaagccttatacttgtaatgagtgtaagaaagccttcagtgtaagggcacacctgattatacatcagagaatccacaatggagagaaaccctatgaatgtaatgagtgtggcaaagcatttagtgtgagctcagaccttatcaaacatcagagaatccatactggtgagaaaccttatgagtgtgatgagtgtggaaaagctttcagtgtgagctcagccctcatcaagcatcagagaatccatacaggagaaaagccgtatgagtataaggaatgtgggaaggccttctatgtgaactcagcacttattaatcaccagaggattcactctggagaaaagccctatgagtgtggagagtgtggaaaagcattcagccagatctcaacgcttattcatcaccagagaatccatactggagagaaaccgtatgagtgtgaagagtgtgggaaagctttccatgggagttctaaccttactaaacaccagaaaacacatgccaaaggaaagtgtcatcagtgatttatgtggcaaatatattccaaagggcttttgttacatcggaagataccattgaaagaagagtatggttaaagttaatgccttaattgacacttcacccttgaaatactgaagtgagaagtcactcaaaagtaactccatcagcattgtttctaaggctctaaaatcacatctacttctgagaagaatggagatttacagacagtcatctgggtggaggacacccttttgggatcagcactgaaagtgacgccatatcccactccaaaccagcacaactataaatactaagcagtgagtggtattctgaagactttgaaggaggagctatttctgaaaataaatttattttgttgaagaattt

SEQ ID NO: 466878 - DNA, 1063 bp, Homo sapiens
ccgccccgaggcgaggcctcggagctggttgctgctcacaggcagagaaacgctgaagtgttcctgaaaactcgtcaattacaggaaaagctgcatgactgcatctttagaggagatggtttcgctggttccaaggattctgttaatgagaaaactccacaggccagcattctgtaagctggctccagcagcccagttgacagtggctgaggccagttcctgatcatcctgaggaacaccagaatggagatttacagacagtcatctgggtggaggacacccttttgggatcagcactgaaagtgacgccatatcccactccaaaccagcacaactataaatactaagcagtgagtggtattctgaagactttgaaggaggagctatttctgaaaataaatttattttgttgaagaatttaaccattaagcgatcaggatatgtgtactgtggttattacttttgagctcaaagtaaggtattagtgattatttgttttaggttgggtcttgtgccgggtgctaggaatacaaaaataagtgaaaaaagcaccctaatctcgaggctcgcagactatttggtgacagggagaagagagtagatagaaaacaacaaatactgtgataaagccgctggatttgtagagtactttgcattgaagagggtttaacaatgactcacgaaaacaattgaaaaggctttggaggaggacgaaagcttggaggaaaagaatgagttcttgagccacatgatacagaagaatgagggaagggatccttgtcacaggatttagggcccacctggatattccaggctgatctcatcttgagatcataaacttagtaattacctgccaagacccttttttcaaataaggtccctcagaaagttatggaatgttaattctagcctctaaatctatagtttctcaggaagaattgctgatagtgtattcttttttaaagaacttttaatcaaatgagttaagtgtaaatgtttccttaagttagaatatcaaaataattcataggaattggagctgaaatcacttttctaattatat

SEQ ID NO: 466879 - DNA, 2270 bp, Homo sapiens
ccgccccgaggcgaggcctcggagctggttgctgctcacaggcagagaaacgctgaagtgttcctgaaaactcgtcaattacaggaaaagctgcatgactgcatctttagaggagatggtttcgctggttccaaggattctgttaatgagaaaactccacaggccagcattctgtaagctggctccagcagcccagttgacagtggctgaggccagttcctgatcatcctgaggaacaccagtcaactcacaaatccctgagagggaagcctccaggatcctagagtagatgaccagatgcccaggcgcaggatccacggaagtcaaagtcaagctttctaggccgacagctgtcctcagtcgcttggtcagatagtctaatctcagtttttcaggaatcaaggccagaggtgtgaacaaggtgtcagctctgaagggaaggtttttctaaggatggacccacaccagaaggtccctagcatatataatggggatactttacaaactcctgagtatgaaaaagtctctcagtatgaggaccagttagaaaggcatgagggtaggcacatggaagaaagacggtataaatgcaatgaatgtggaaagaagtttgcccagagctcaggccttgttcgacatcagagaatccacactggagagaaaccctatgagtgtgatcactatggaaaagcctttagcgtgcgctcaaccctcactgtgcatgaaagaatccacactggtgagaagccttatacttgtaatgagtgtaagaaagccttcagtgtaagggcacacctgattatacatcagagaatccacaatggagagaaaccctatgaatgtaatgagtgtggcaaagcatttagtgtgagctcagaccttatcaaacatcagagaatccatactggtgagaaaccttatgagtgtgatgagtgtggaaaagctttcagtgtgagctcagccctcatcaagcatcagagaatccatacaggagaaaagccgtatgagtataaggaatgtgggaaggccttctatgtgaactcagcacttattaatcaccagaggattcactctggagaaaagccctatgagtgtggagagtgtggaaaagcattcagccagatctcaacgcttattcatcaccagagaatccatactggagagaaaccgtatgagtgtgaagagtgtgggaaagctttccatgggagttctaaccttactaaacaccagaaaacacatgccaaaggaaagtgtcatcagtgatttatgtggcaaatatattccaaagggcttttgttacatcggaagataccattgaaagaagagtatggttaaagttaatgccttaattgacacttcacccttgaaatactgaagtgagaagtcactcaaaagtaactccatcagcattgtttctaaggctctaaaatcacatctacttctgagaagaatggagatttacagacagtcatctgggtggaggacacccttttgggatcagcactgaaagtgacgccatatcccactccaaaccagcacaactataaatactaagcagtgagtggtattctgaagactttgaaggaggagctatttctgaaaataaatttattttgttgaagaatttaaccattaagcgatcaggatatgtgtactgtggttattacttttgagctcaaagtaaggtattagtgattatttgttttaggttgggtcttgtgccgggtgctaggaatacaaaaataagtgaaaaaagcaccctaatctcgaggctcgcagactatttggtgacagggagaagagagtagatagaaaacaacaaatactgtgataaagccgctggatttgtagagtactttgcattgaagagggtttaacaatgactcacgaaaacaattgaaaaggctttggaggaggacgaaagcttggaggaaaagaatgagttcttgagccacatgatacagaagaatgagggaagggatccttgtcacaggatttagggcccacctggatattccaggctgatctcatcttgagatcataaacttagtaattacctgccaagacccttttttcaaataaggtccctcagaaagttatggaatgttaattctagcctctaaatctatagtttctcaggaagaattgctgatagtgtattcttttttaaagaacttttaatcaaatgagttaagtgtaaatgtttccttaagttagaatatcaaaataattcataggaattggagctgaaatcacttttctaattatat

SEQ ID NO: 466880 - DNA, 716 bp, Homo sapiens
agagggcgctccacgaaagtcactgcctcggcagctgaggagactccggcgctcgccatggccgaagaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgattcgacgggcaaccaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttgcttccaccacatcctgactactaccgtatagttttctctattctttcatttcccccttccccattcctttactgtacataaagtaactggtatatgtgcacaagcatattactttttttttttaaaactaaacagccaatggtatgttttgattgacatcaagtggagacggggcggaaaaatactgattctgtgaaaataccccctttctccattagtggcatgctcattcagctcttatctttatattccagacattcacgtagtgaaaacctgtgtttaattatctgagcct

SEQ ID NO: 466881 - DNA, 3683 bp, Homo sapiens
gtctagagctggtcggaactgatggctaccagtggcaggtacttcctgcaggagaaacagtgtaagcaaagatgggaagaggagaggcaagaattgagtgttgtgaatagttctgaactagagaccttttgaaaccaaaaggaagatggtcttgagtctttcttgttacgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtggttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtattttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaactccatttccgtctccactgtactgagagaaa

SEQ ID NO: 466882 - DNA, 3698 bp, Homo sapiens
agagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtggttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtattttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaactccatttccgtctccactgtactgagagaaa

SEQ ID NO: 466883 - DNA, 858 bp, Homo sapiens
cacggctccatgcgagagatgcctgttccttctctgataaatttggcagcttcacgtaccctaagtttttgcatttctgacaaccacgtgtcctcacctggacccgccaacccatcctgtggcctccacccaggaactgactcagcatgagaggacagcctcaattccccatgatttcatctccaacccaaccaatcagcttgccccctaccctggtcccctgcccaccaaactgtctttgaaaaacccataacctccatgccttcagggagataatttgagtactaacgccatctcccatggggcatggccgacctcgtgtctattaaactctttctttactgcaatgttgtggtctttctgggtgcagtggacaggaaggactccttgggaagttacacacctatccccacaatggtagggttcttcctcttggggaagcctcctgcagtagggaatacagccctcttgttcctatcaacacaaactaagaatgggataggtttatctcgatccctgtcctgctggttctgtcattgggtgaaggcaaaactagagctgcaacaccagagttatgctattaagtggagctgctggcatttgaaatattccaactgtggctcttttaaaaagggtcagcatctaatgggacaggtgggactaaataagaagatgagcggcgttggggctgcaacagggaagaagaagtcggagtgccagcccagacggcgtttgtggggttggagcgagcaggcgacacatcctgttagggtccggagaggatgtgatactccgcaccaaatacaaactggtcctcgccctgaactttaaaaactaaggtcatgaacacattcagct

SEQ ID NO: 466884 - DNA, 4661 bp, Homo sapiens
aagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcagtctctattggaagcagatgccctcaaggggatatgtggagaatttggatgcattgatccagaatggaaatattctggtttatgtgcaattttgggattcactatccatggacattttccaactcgatgtagctggaagaatacaagtttagctatgacaaactacaattatttgtattgtttaccaaatgcacctacttgtccacaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgatgatttaaatttagtagttcattactgctacagaaccaaacgggttcacttgcctggcacaggaaagccaaacatccacatcaacaggagaaaagagggcatttatttgcagagtgtcaagcaaggagaattggtcccctcaaaattaagacccagtttccccaatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttgcggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaagaggaaacatgatgagattcaaagaagtttgcctgttaaaccttccaaaatgctaaagccatcagggacaccattttcaccagacaaagtaggagactggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattcaaaacataaagaaataagttcacaaccaaaagaattctttgaaagaaagagtagtgaattgaaaagccaaccaaagcaggtgttcaacgtttctcatataaacattagtgctttgcgggcttcatataaagtagcacttccggttgccaagtctaaaacaccatacacaattgctgagacactagtgaaagactgcatcaaagaagtttgcttggaaatgttgggtgaatctgcagcaaagaaggtagctcaggtaccactttccaatgacaccatagctcgacgtattcaggaactggctaatgatatggaagatcaactcatagaacaaataaaactagcaaagtatttttcattgcaacttgatgaatgcagagatattgctaacatgataattcttttagtctatgtgaggtttgaacatgatgatgatataaaggaagagttctttttttcagcctctttgcctacaaacacaactagctcagaactgtatgaagctgtaaagaattatattgttaacaaatgtggtttggaatttaaattttgtgtaggagtatgttctgatggtgcagcttcaatgacaggaaaacattctgaagtggtaacccagattaaggaacttgcgccagaatgtaaaacaacacattgcttcattcatcgagaaagtcttgccatgaaaaaaatatcagctgaactaaatagtgtacttaatgatatagtaaaaattgtgaattatataaaatctaattcattgaattcaagattattctctttattatgtgataatatggaagctgatcataagcaactgttactgcatgctgagatacggtggttatcacggggaaaagttctgtcaagaatgtttgaaatacgaaatgaactcttagtgtttctgcaaggcaagaaacccatgtggtcccaactttttaaagatgtgaattggacagccagacttgcttatttgtctgatatcttcagtatttttaatgatcttaatgcttctatgcaagggaagaatgcaacttatttttcaatggcagataaagttgaaggacaaaaacagaagttagaagcttggaaaaacagaatttctacagattgttatgacatgtttcataatttaacaacaattatcaatgaagtaggtaatgatcttgatattgcacatctgcgaaaagttatcagtgaacatcttacaaatttgttagaatgttttgaattttattttccatcaaaagaagatccacgcataggaaatttgtggatccaaaatccatttctttcatcaaaagataacttaaatttaactgtaactctacaggataagttgttgaagctggctaccgacgaaggattgaaaatcagttttgaaaatacagcatcacttccttcattttggataaaagctaaaaatgactatcctgagcttgctgagattgctttaaaattgctgcttcttttcccctcaacatacctctgtgagaccggattctctactttaagtgttattaaaacaaaacatagaaacagtttaaatatacattatcccctgagggtagcattgtcatcaatccaacctagattagacaaattaacaagcaagaagcaagctcacttatcacattaaaagctttaaatattgatatgtaaggtattggttcaaagtatgcatataagcattgagtgtgaggaatttgctatttcactttaaactttctgtctagttacagttatggaagtatgagaagttatgagtgaaacagcaattttctatataaattgcctatatgtatattttcaattaagaatgtgtacagtttttataattctatttttcctcatatttgtcgtatttattaaaatataattttaaatctgttgattctaatattaaaacatttgatcttatattttgtgtcttcttct

SEQ ID NO: 466885 - DNA, 4493 bp, Homo sapiens
aagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcagtctctattggaagcagatgccctcaaggggatatgtggagaatttggatgcattgatccagaatggaaatattctggtttatgtgcaattttgggattcactatccatggacattttccaactcgatgtagctggaagaatacaagtttagctatgacaaactacaattatttgtattgtttaccaaatgcacctacttgtccacaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttgcggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaagaggaaacatgatgagattcaaagaagtttgcctgttaaaccttccaaaatgctaaagccatcagggacaccattttcaccagacaaagtaggagactggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattcaaaacataaagaaataagttcacaaccaaaagaattctttgaaagaaagagtagtgaattgaaaagccaaccaaagcaggtgttcaacgtttctcatataaacattagtgctttgcgggcttcatataaagtagcacttccggttgccaagtctaaaacaccatacacaattgctgagacactagtgaaagactgcatcaaagaagtttgcttggaaatgttgggtgaatctgcagcaaagaaggtagctcaggtaccactttccaatgacaccatagctcgacgtattcaggaactggctaatgatatggaagatcaactcatagaacaaataaaactagcaaagtatttttcattgcaacttgatgaatgcagagatattgctaacatgataattcttttagtctatgtgaggtttgaacatgatgatgatataaaggaagagttctttttttcagcctctttgcctacaaacacaactagctcagaactgtatgaagctgtaaagaattatattgttaacaaatgtggtttggaatttaaattttgtgtaggagtatgttctgatggtgcagcttcaatgacaggaaaacattctgaagtggtaacccagattaaggaacttgcgccagaatgtaaaacaacacattgcttcattcatcgagaaagtcttgccatgaaaaaaatatcagctgaactaaatagtgtacttaatgatatagtaaaaattgtgaattatataaaatctaattcattgaattcaagattattctctttattatgtgataatatggaagctgatcataagcaactgttactgcatgctgagatacggtggttatcacggggaaaagttctgtcaagaatgtttgaaatacgaaatgaactcttagtgtttctgcaaggcaagaaacccatgtggtcccaactttttaaagatgtgaattggacagccagacttgcttatttgtctgatatcttcagtatttttaatgatcttaatgcttctatgcaagggaagaatgcaacttatttttcaatggcagataaagttgaaggacaaaaacagaagttagaagcttggaaaaacagaatttctacagattgttatgacatgtttcataatttaacaacaattatcaatgaagtaggtaatgatcttgatattgcacatctgcgaaaagttatcagtgaacatcttacaaatttgttagaatgttttgaattttattttccatcaaaagaagatccacgcataggaaatttgtggatccaaaatccatttctttcatcaaaagataacttaaatttaactgtaactctacaggataagttgttgaagctggctaccgacgaaggattgaaaatcagttttgaaaatacagcatcacttccttcattttggataaaagctaaaaatgactatcctgagcttgctgagattgctttaaaattgctgcttcttttcccctcaacatacctctgtgagaccggattctctactttaagtgttattaaaacaaaacatagaaacagtttaaatatacattatcccctgagggtagcattgtcatcaatccaacctagattagacaaattaacaagcaagaagcaagctcacttatcacattaaaagctttaaatattgatatgtaaggtattggttcaaagtatgcatataagcattgagtgtgaggaatttgctatttcactttaaactttctgtctagttacagttatggaagtatgagaagttatgagtgaaacagcaattttctatataaattgcctatatgtatattttcaattaagaatgtgtacagtttttataattctatttttcctcatatttgtcgtatttattaaaatataattttaaatctgttgattctaatattaaaacatttgatcttatattttgtgtcttcttct

SEQ ID NO: 466886 - DNA, 1285 bp, Homo sapiens
ggagattatcccagatacctgtgtccaggatggccacatgcgtgctgctggagtgtctcatgagagatgcaaagtgcctgaattttctgacacttcctgttagacctctcccccagacacatatgatccaccattccgtctctgactataaggccaccctgaggtgctgggccctgggcttctaccctgtggagatcacactggcctggcagcaggatggagaggaccagactcgggacatggagcttctagagaccaggcctgcaggggatggaaccttccagaagtgggcagctgtggtggtgccttctggagaggaacagagatacccgtgccatgtgcagcatgaggggttgcccaagcccctcaccctgagatgggagcagtcttctcagcccaccatccccatcgtgggtatcgttgctggcctggttctccttggagctgtagtcactggagctgtggtttctgctgtgatgtgcaggaagaagaactcaggcagcgaccatgcgcagggttctgatgtgtctctcacggcttgtaaagtgggtgctcaggccaccgtgcgctttatgtggtcactgctcagctgggtcatctttgctgctctgttgtccttggctgtatgatccgtccctacggggcttagcgggttttctccccgtgtgcggagatgagagattgtaataaataaaagcacaagacaaagagataaagagaaaacagctgggcccgggggaccactgccatcaagatgcggagaccgccgcctgccttggcctcccaaagtgccaagattgcagcctctgcccggccgccaccctgtctgggatgtgaggagcccctctgcctgactgcccagtctggaaagtgaggagcatctctgcctggccgccatcccatctaggaagtgaggagcgtttctgcccggccgcccatcatctgagatgtggggagtgcctctgccccgccgccccatctgggatgtgaggagcgcctctgcccggccgtgaccccgtctgggagccccagcgaagccctcagatgctgcggcccctggctgacaactggagtgcaaccttgtgagaggccctgagcaggaagcactcagggaaacctctcctggattcctgacgattggaaactgtgggagatgagaaacatttgttgtttcgagctaagttttacgtaatttgttatgcaacagtaaataatatattttcacaagagaggatgtattattacacatcaaattgcatttgctctaaatgtgtcatcatcatca

SEQ ID NO: 466887 - DNA, 1280 bp, Homo sapiens
cagatccggtcctcgggcgaccgctctgtcccagttgggcgagactacctggtcctgataacagtggataacggctttaacggccagaaggtcagcgcagtcccggatgaggacgagtagaacggtaacggccatggggcggttggccttccttctaccagaccttgatgtgggaagagagaaatggagtaacaagccacatttggcgctttggagatgcccaccacgctttgggaagatgtaccagcgtttatagaaggcccgagtgtataagagtctcgctcggtcagccacgctggagtgcagtggcatgatctcgactcgctgcaacctctgcgtcccgggctcaagcaattctcctgcctcagcctcccgaatagctgggattacaggggtgtgccaccacgcccagctaatttttgtatttttaatagagacgggtttcaccttgttggccaggctggtcttgaactcctgaccttaggtaatccacccgcctcagcctcccaaagtactgagattataggcgtgagccacagtgcctggccaaaaaaaaattcctaatttttttgcatattagctacagctggggaaggaattcctaagctgaaagataaagccaaaaccttaacccagaatacaacaaaaatagttaagaacatggaacatgtgaagcaagctgagatagataaacacaactgcgaattctttgcatctcctcccatcagaagaccttccgggtttcatcaactctatctccaattcaatcctcgtctacacacacagttcaggggaggcaagatagcggctacattttctgttcttgaccttcagctccaagggactgtttcccggatgcttcggaccgagtgtttggtagtgtctggggaggactcggtcagggagccccctcctttcaccctgctcccagcgcggcgaggcccaggtccggtcctaggtgagtttttctctccggctggaagactcgacgccgtggataccagggacccgagccctccggggctgctggctttggagggatttccagacgttgcagtcggggaattgggtttccacgttgctgctggagcttttcgtaagtcgataagagcagcatctttctctttgtctccaaacccgtgaatttgatacgctttgaaagcgttcttctaggcgaaagagcttggtactttcatgcttggatagaaggggagagttcaataccgtgcacgcgaccacaaagttgttttcgacgagaattcgatgggaagcggaggaac

SEQ ID NO: 466888 - DNA, 687 bp, Homo sapiens
cagatccggtcctcgggcgaccgctctgtcccagttgggcgagactacctggtcctgataacagtggataacggctttaacggccagaaggtcagcgcagtcccggatgaggacgagtagaacggtaacggccatggggcggttggccttccttctaccagaccttgatgtgggaagagagaaatggagtaacaagccacatttggcgctttggagatgcccaccacgctttgggaagatgtaccagcgtttatagaaggcccgagtgtataaggtgagaaagctactctcagcttccccgaaaacttttacaagaaaacatttgccacatctagcccctccagatgtaaagaagctgccgatgtatgatagactaagaatatcacacatcttgtaaattcccatttgtttaaaaaaatcgtagaaaataaacatcttctggagatgactttttgaaatggagatgttgcatcacctctggagcagacacatacacgtttgttcagtgggttagactaggacatggagaagatctgagaaggacgagaagaaggtcctatgccagactggtcatatttagaagacgtttacatattataatcgttgtcttccgtgtgcattttattcctcactactgtatatgtagttgacaactccaagtactttttgaaatgtctagtctttttt

SEQ ID NO: 466889 - DNA, 3264 bp, Homo sapiens
ttctccccagacgccgaggatggccgtcatggcgccccgaaccctcctcctgctactctcgggggccctggccctgacccagacctgggcgggaccgggggagccgcgccgggacgagggtcgggcaggtctcagccactgctcgcccccaggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccgtctccgggtccgagatccaccccgaagccgcgggaccccgagacccttgccccgggagaggcccaggcgcctttacccggtttcattttcagtttaggccaaaaatccccccgggttggtcggggctgggcggggctcgggggactgggctgaccgcggggtcggggccaggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggtggagaaggggtgaagggtggggtctgagatttcttgtctcactgagggttccaagccccagctagaaatgtgccctgtctcattactgggaagcaccgtccacaatcatgggcctacccagtctgggccctgtgtgccagcacttactcttttgtaaagcacctgttaaaatgaaggacagatttatcaccttgattacggcggtgatgggacctgatcccagcagtcacaagtcacaggggaaggtccctgaggacagacctcaggagggctattggtccaggacccacacctgctttcttcatgtttcctgatcccgccctgggtctgcagtcacacatttctggaaacttctctggggtccaagactaggaggttcctctaggaccttaaggccctggctcctttctggtatctcacaggacattttcttctcacagatagaaaaggagggagttacactcaggctgcaagtaagtatgaaggaggctgatgcctgaggtccttgggatattgtgtttgggagcccatgggggagcccacccacctcacaattcctcctctagccacatcttctgtgggatctgaccaggttctgtttttgttctaccccaggcagtgacagtgcccagggctctgatgtgtccctcacagcttgtaaaggtgagagcttggaggacctaatgtgtgttgggtgttgggcggaacagtggacacagctgtgctatggggtttctttgcattggatgtattgagcatgcgatgggctgtttaaggtgtgacccctcactgtgatggatatgaatttgttcatgaatatttttttctatagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtccacgtgtttcttgtgctgatttgttgcaggggaggagagtagatggggctgtgcccagtttctgttctggccaccatgggctttatgtggtcacagctcacctgggtcatctttgctgctccattgtccttggcccttcagtagaaccttgtcccaccaagacctgtgatcacagggagttggatgtcacctagggtggtccctgcatacaaatctccttgtggtatcaagagacaaattttcagacctgtccaggtcttgccttcctcccagggctttttccttaatggtattttcgatttttctccaatctttttaaaggaaccagattgtgacatttgcagagaggaggggtcccatagtttctcatcatggttaactttctgttggaactcctcttctgccctcctactcttcttcctgctctgagttgtagtaatcctagtgctggctccaatccaaactcatagatttataaagcagagtctaatttagattcatatgtggttggaaaattgtacccataaggctagggttattgttcctgaagagaaatatatggttttgtgctgaagtgtgcaggagggttggtgtgggaggagggaggacacacaagcagccctggtgagaaaagcactggcggcatggatgtccacgtgaacttatgttctttagctgccacaaaacagcatttgccctgtggctacattaataaagatatgggctttagaataga

SEQ ID NO: 466890 - DNA, 2184 bp, Homo sapiens
  misc_feature (5)..(6): n is a, c, g, or t
  misc_feature (8)..(8): n is a, c, g, or t
agtgnncnaggaaagcatgagtctttccaccccccgccctgagatttactgacatatgaacacatatgattggcatgatataagaaccactcatctgctggccatctctccaggtctggagccagagaagatgatctgaaattgtagcaggagaaattgaggtaggatactaagaaagcttttcaggagtggggctaggcaagaggtgcagcatgagggaataagagtgaatcctcagtatctaagggaggtggcaggtggcgggggacttctttctttgggtcatctttggtggtgatttgacaggaaggaacaaagtggcttcaaacattatacaagtctctagtctgttctgtgtcctgttttctttctcattctttcagtgtggaatctatatgaccctgggagggatgttggttggaagaatgaccagctgatggagatgctgctgtaattattggtggtaataatgggcagcagtgagccacccggtgtgacagtgtaggagaaaacagtccaaactcctgccaaactctctctactgatggcaaatcagaggagactcaaattgtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaagctcaacaatggacatctctctttgtttcttctgcttcatcctgttttggacccttgtcttgcttttctgtgtatattttgaggctgatgtttccatgcattaatgtgagtctgtctaaaagaggatattgtcagtgtgatgttagagtcccagtctgctcatctgtagaatagagtaattggactaactaatgcaaaaccctttcaggactaaaactgtgtgaactcctggttgatagtactagaaacttggctagaaatgtaatcaggttttatatacactagtaattatcctgcaaatatattaaaacctgaaagttactacataattttttctctctttttcttccttctgcatttgtcttatctttccttttcctttctttgctatggcaattattttatcttattctgttaaattttctatcacaaaagttacatgctgtaggtaataaattcagaaagcactgaaaggtataaagtcaagactaaaaacttgtcttcctttctccctccattcatagtcctcagaggtaaccattgtttgatttttgtacatccttccaaaaaatgtgtgtgcttatgaatgcactcttacacacacacacacacacacacacacaccctcaaaggattctctctatatttttttctgtaactcatttttgttatctaaaagtgtggcttgaacattttctcatcagcatgtatagatcttctgaattattttcaagaactgtgtggtattaaattctatgaatgtaccataaattggcagacattgggtcatttccaagctattgttttgttttaagattacacagaacgttctaatgaatatccttcaacatatatattggaggacctagaatatccaagatatattttggtgagagcataaggtagaaatctaactttagtttttccaagttataatcaatttgtcctatcaccatttgttgaatg

SEQ ID NO: 466891 - DNA, 686 bp, Homo sapiens
gcttcggtgtcaggtgagctagatggtatgtgtggcccgagccattgcatgtggggagaaaggtcaggcaggattttcacgttttcatctatttggacagttccttcttcgagcggggtcgagagcgagaggagcgacagctcccaaggtacatttcatcattcaacgtactcagatgcagggaatttgggttgcattttccatgagccttcggctagcagaaaatctgtcaaaagatcttgaacaatcccttaattctttccgcctgggattcaattgcgccaagaggactaattgtgctaaagctataaaagtgtgctttgctctcagtggaattcatcctcagagttggtcactccctggtcgagcacgaggctacaaagctgtacagcatgttgctgaactgaataccgtcggcaattgcaatacagtggtatttgtgtatccgaacatacgaaagcttctacaaggtgcggatccataaggaagatattaggaaacatctaattgaagcttgaagaaccaaaatgaggaaggcagaattaggaaagaccctgtccggtgacgcctccccttctggtttccatctgtgccccctctcaggagccgcgggaacacaagcctcgagcaggcaaagtctctttggatttgaaatacaaaaccgttaagtgagctccgaccaggtc

SEQ ID NO: 466892 - DNA, 999 bp, Homo sapiens
gcttcggtgtcaggtgagctagatggtatgtgtggcccgagccattgcatgtggggagaaaggtcaggcaggattttcacgttttcatctatttggacagttccttcttcgagcggggtcgagagcgagaggagcgacagctcccaaggtacatttcatcattcaacgtactcagatgcagggaatttgggttgcattttccatgagccttcggctagcagaaaatctgtcaaaagatcttgaacaatcccttaattctttccgcctgggattcaattgcgccaagaggactaattgtgctaaagctataaaagtgtgctttgctctcagtggaattcatcctcagagttggtcactccctggtcgagcacgaggctacaaagctgtacagcatgttgctgaactgaataccgtcggcaattgcaatacagtggtatttgtgtatccgaacatacgaaagcttctacaaggtgcggatccataaggaagatattaggaaacatctaattgaagcttgaagaaccaaaatgaggaaggcagaattaggaaagaccctgtccggtgacgcctccccttctggtttccatctgtgccccctctcaggagccgcgggaacacaagcctcgagcagaatccaaccacttgatgattcgaaatcaccgcaatgccatggaatgtaaaaactgctctcgccacgtctagagaccgatgcctcttcctccgctgggaacacggttcatctccactctccgatttcacggttttatttgccctctgggacgcgctgacattgttctaagcacattttctaagtgattgtgtgagtgtgggtgtgttttgttggacttgaagggagtctaatttctagaagttcctttcaggagtctgcctttactgcaaagttgatgtattcgaaaacacagtaactcttaatggcaacagaatttgtcacctaattaagtgcaattcggtcataaaagaagccacagaatcagcacg

SEQ ID NO: 466893 - DNA, 2340 bp, Homo sapiens
gcaagctgagggagccggctccggccttggccagcccagaaaggggctcccacagtgcagcggcgggctgaagggctcctcaagtgccgccaaagtgggagcccaggcagaggaggcgccgagagcgagcgagggctattgtgcaacggagccagtttctccagacaggctggagagaccacttgcatcagaatcatctggggtgccccttgaaaatgcaatgttccgggccaacgagtcaatctcggagtgtaaatcttgtgaagctgtattttaacaagctcacttggtgatttatttgtgtacgctatttaaaactctgtgaaccaccggtctaggctatactttgcagtgtattaaggtggtcttcggcacctctcgcagacccccttcctcttgcctctagcgccaacctctcagcctctcgcataccaggggaggggctttgcaaaaccttccacgaaagtgaatcccagcacagccctgctgtagctggctctcaggcgcaagcgcagagctgcgaccgctgctgatacgttgctcagtctcagtgtggtctctgttttgcaactggtcgtccgcgtcaggagacttaggtccaggcgactgcccagacaatgactggtcccgcataccgagcagagcatgatcagcagcagtctgagtggaagagtgcctgtgatcttagggaacctgatgggcgttggagcagcggttcgacgcatgggtttctctttaatccttccgacttccccaagcccagcgcactcaggttccgctccaagtgcgggacccgcccggggtgtgtcgggggtactcggccggaggcggccggtgagtgaggcttacagggccccgggaccaaggaagaagtaaggggactagtgccatagtgtctttgaactcataccccatatgaagagaacgtcaaagaggctggatcacctaaagggtttagagaaagtttggaattggctcagatctgtcttttatcataaaagatgaacttgaaacccagacataacttagatacagatgacatttacactttaaatgtctttcagatagggggatttgagctgaaccaaagcatcaacaccaatcagactgtttccgaagaactagagttttctgggtcagcaatggaaagcctcagagggaatactgctcagggtcctacaaatgaagaagactataaaaacgaaggccaattatcaaggcaaacaaaatgtcctgcacagaagaaatcctcttttgagaacacagtggtcagaaaagtgtcagtgacactcaaagaaattttcacaggggaggaaggccctgaatccagtgaatttagtctaagcccaaaccttgacgcacaacagaaaattccaaagggacatggatccccaatatctaggaaaaactccaaagataattcagacttaattaaacaccaaagacttttctcacaaagaaaaccttgtaaatgcaatgaatgtgaaaaagcctttagttaccaatcagaccttcttgtacacagtagaattcatggtggagaaaagccttttgaatgcaacaaatgtgggaaatctttcagccgaagtacacaccttattgaacatcaaagaactcacactggagagaaaccttatgaatgcaatgaatgtggaaaagcttttagccggagcacacatcttagtctacatcagagaatccatactggagaaaaaccatatgaatgtagtgaatgtggaaaagcctttagccgaagcactaaccttagtcagcatcagcgaactcatactcaagaaaggccttacaaatgtaatgaatgtgggaaagccttcggtgaccgttcaaccataattcagcatcaacgaatacacactggagagaatccctatgaatgcagtaaatgtggaaaagctttcagttggatctcatcgcttactgaacatcagagaacacacactggggagaacccctatgagtgcagtgaatgtgggaaagtgttcagtcgaagctcgtctcttacagaacatcagagaatccacagtggagaaaagcctcacgagtgtagagtgtgtggaaagggcttcagtcgaagctcatcccttattattcatcagagaactcataccggggagaagccgtacaaatgtaatgactgtggaaaagccttctgtcagagttcaactctgatcagacatcagcaccttcatactaaagagtaatatctgagcttttattaatgttagcataagaacacatatacctaacctcccaccactgaaatatatatatttcaagtatatatatacttgttctaattttcttttattagatacctatacc

SEQ ID NO: 466894 - DNA, 1022 bp, Homo sapiens
gcaagctgagggagccggctccggccttggccagcccagaaaggggctcccacagtgcagcggcgggctgaagggctcctcaagtgccgccaaagtgggagcccaggcagaggaggcgccgagagcgagcgagggctattgtgcaacggagccagtttctccagacaggctggagagaccacttgcatcagaatcatctggggtgccccttgaaaatgcaatgttccgggccaacgagtcaatctcggagtgtaaatcttgtgaagctgtattttaacaagctcacttggtgatttatttgtgtacgctatttaaaactctgtgaaccaccggtctaggctatactttgcagtgtattaaggtggtcttcggcacctctcgcagacccccttcctcttgcctctagcgccaacctctcagcctctcgcataccaggggaggggctttgcaaaaccttccacgaaagtgaatcccagcacagccctgctgtagctggctctcaggcgcaagcgcagagctgcgaccgctgctgatacgttgctcagtctcagtgtggtctctgttttgcaactggtcgtccgcgtcaggagacttaggtccaggcgactgcccagacaatgactggtcccgcataccgagcagagcatgatcagcagcagtctgagtggaagagtgcctgtgatcttagggaacctgatgggcgttggagcagcggttcgacgcatgggtttctctttaatccttccgacttccccaagcccagcgcactcaggttccgctccaagtgcgggacccgcccggggtgtgtcgggggtactcggccggaggcggccggtgagtgaggcttacagggccccgggaccaaggtgggtgctcttggaggttctggaaggcggaaacacgggttcttcgagggaaacgggcgaaagggtcgcgggtggtttggctgcaggtcgggtcaggaggcacctccacggttgggacgccgcgtggcgtggggtcatgaagcccctcagcccgct

SEQ ID NO: 466895 - DNA, 2976 bp, Homo sapiens
  misc_feature (3)..(5): n is a, c, g, or t
  misc_feature (8)..(9): n is a, c, g, or t
  misc_feature (12)..(13): n is a, c, g, or t
tgnnnaannatnnggtccaaaagcatcaacaaccttgtcacttgcagcgtgggctgctgatcagcaacactgacctaacctgggagtttctcacaaatgcagaatatctacaccccatcctacacctacagcgttccgaggacaacatagtaagggatgctcattcatctctctgccagtgctttctgcggtctcttcagctagttctatcaggcacttctggcaatctggagcggcagccggctgggcggcgaggaaaccgctgcacggatcccgcctcccagcacacgcagtcggcagttgcagcctccaagaccgcggtgccaccaaaccaagcgccggacgcggtggcgcgcgcctgtaatcccagctccccgggaggctgaggtcggcggatcgtgggtgctcgggggttcggagctacggcgctgtgtggagcgggcgtccgcaccgggcctggcaccaacatggtactcccgggggagcccgggagtaccaggttgtctaaggagggggggaccaggcccaggccggacacggagcaggtcaaactccccgtgttgggcgacggtgggaccgcgcctgcgagcaacgcctgcagttccgcccgggacatccgacgagacccgggaatgatgattcattcagtcagtgggagccggaagaaactcagcagcctgcaagatggagctgcagacatagataaggaagctggaaacttgcatgggggaaggctggcagctgcaccgatagaaaaggtctacctgggggaaacttcccttcagttcaccggccgtgcctctctctatccttttcctcggagcaggctgtgctatgatcaaggcattgtgacccctgtgacccacacgtacacatccagaaggtctcctggagccagaaagtctgggacaacaggaaaaccacaaaagaagaaaaacagctcctttacgaacttcccaaattactcttatggcattgccacgccctctgccgtccagattttattggttggtgcaaaacaggaggtcagtgaatacgagagcatgaccgtgcactaactcgtcggaaaagtagaagtcaactgtgtgctttaccgtgcaggattgcaaacaccagagagaaaatcagtctctggaatgatgcctttgatggaccaagatgcagctgatgaagcattgaaccaattagcacctagcaggagggcacccttgctctgtgtccttgaaggttaaagctgtcaaaaagtggtctccctcaagttcggccatcttgctctcagagatctagaactggactcagtcaaaattttgggccaaggagaccgacgcgctgtcgcctgcactaagagaaacgcaacgaacaactttgtcaatgcattgcattatactatagcagcaactatacttttaaatgattcgaatcttgaggtttcaaactgaaccgtcttgtgccttttgcccggcgggcatttctgcggggaccgcgggtcaccttctgaatttttaccttcataaacagcaaggactgcgctctttcgcacggcgccccgttttttcgtagagttccgtcggccaaaaccacttgaaactcgctcagcggcgtcggggctccagccaggcgtcaccttccacagcgaacctgcgaaccacagcgtcccctgggggtctccgtccgcgtggccgcttcctcttacatcggtgacgcaagggaagggcgtctaggatccgccggtttccttcctcactgctcccatcagtgcgaaagcaacgtgttgggggttcggggtgtgtggcggctgaacagctgcctgaagttctctgatggcgctggagggagctccagagaagaggtcatggggagaaggcacaccttaaacgccccggggtggggggggggggcgacattccctaatgggaaaaaagacacaccttaaacgcagtagagggcgacattctctactagggaaaatgcggaagaacacagttgtaatcaacggtagcaacagtgcctagaacacagcaagcactaataagtgtttattaatattaggaagtgattgataaactcttggaagtaaatgtgctcactgaaaaaatagtgaataagaaggtaaaggacaatgtctttggggaatctcacaattaagggtcaggaaatcaggaataactaatataagagacagaaggaccagcctaagaggtaggaaaaacagaaagtaacaccagaatcgttatactcaggcactggtcaaaatactgactactgaggtctgagaaacagtcactggagagagggatttcctactcccatcaagttcatgggtactccatacttgatgttttcttttcttatgtccagtaagatttgagctcactctaaaagcttttccacattcctcacattcataaggtttctccccagtatgaactcgcttatgtccaatcagagctgagccctgacggaaggacgtgccacactcactgcaggtcacttcctcagagccttctttctcttctctcagtttctcccttatagatgtttcccattgattctctaatttgacatcctgaacacaaacttctctaaccttaggatcccgggaatcaacttttaggagactgttaaatttcatccagtaggcttctccattttcaaaaatctcttgttgtgaacttgccttttcattctcaggccacatcttgtcagctgacacttaaacaagaaaatacaaatgtcagagggaaggaaataagtttctttaacagtcttccactgctgtcctggtttcttcctactggtcagatccagttctcaaacaagctgtgaagtggctccagttgatgccagcctcctttggagaacacatgttttggtggtgccagccaaagggcccttcttgacccacagtgccgctactgtttggcttaatgtgtcaaacactgccctggatttggggttcattagcaacactaaacc

SEQ ID NO: 466896 - DNA, 506 bp, Homo sapiens
cccacagtccctgcactcgtgaggcttctccccactgtgggtttttttatgtcggcaaagagctgatctactgttgaaagccttcccacactgggtgcaattaaaaggtttctcccctgtgtggattatccggtgcatagaaagctgatttctggtcttgaatgctttcccacactcattacacacatggggtttctcaccagaatgaatttgctcatggagaattagatctgagtgccaactgaagtttttgccacacctggcacattcatggagtttctgtgctataagaactttattacattgactatgttttgagtttggattcaagtttttactaagcactttctggttctttccttttttgcaggtcacttcctcagagccttctttctcttctctcagtttctcccttatagatgtttcccattgattctctaatttgacatcctgaacacaaacttctctacccagagccggggataggatcctctagatcacccaca

SEQ ID NO: 466897 - DNA, 4159 bp, Homo sapiens
gagcagaaatgcgttcgccaaatatatcgactatatttcctgctcacctcaccctctcacagatgctgattttgagagcgtccccaatgaacttcccgcacacaaatcgccatctcagtgtctgtttcctagggaactgaccgatgacaaaaagcaagtgactgatgcctacggtggtctcttgaggtcaaaatcataggatttctctcccccgcaaataatggcccttacttcgtaaacacgctggctccgtaatccctattattgttttgggggtttggttctgtccagggaggaggtgagggcagatgctcaagagaggctgtccccaccgtccttttgtctcagcgaaccgcagtccgcgcccgagcgccactagctgtcctgggacgggaactgcagcggcaagtgtgtgactttcttgagcccggagccacaggcctgggaagcgccgctgagacttcagggtcgtagtgacagaggaaccacccgaggctaggcggggagagggtgcagtttccggatcccgaaggcttcgagaagagccgacctgtctggaagggtctccaagaacagagaggactctgcaaccatcactcgggagccgcgtcctttcatccttgagacagctccgtggtccaacggttccccgatccgctggccgagatctcaagcttggatgcaacttcggattcgccccaggcaggaggaaggaagccccgattggaaacgtcgcgggttcgatccccgtactggccaagtattctctgtggcttttatcaccagaatggatagtaacccagacatcgatctaaacgtgtacctgtgtgtttctccaggcttaactttgccccgagaaaacggatctgtgaatttggtgcgccctcgcttactcgacagcgaagggaaggtgaggagagtcaaaggcacatggagcattaacagttggaataaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacctgacgcaggtgggacttggggaaatgtcgagaaacctaggtctgggacttgagttggcttccagggcacacattcttgttcagaagaaacacattgcaaaaatcgggaggtgacgggcagatgaagtgtcggcgcttcgcctcgggactccagtgcaacctatggggcttttggaaatgaggaagtcgatgactctgcagggactcctctgacccaggagcagatggcgctcgtctgggcactccccaggagaaaaggtgcatcgggaagcagcctggcttgtggatggtggacaaggtggaggagagagaattccttggcagtagcattatgaacaaatgcagggctgagaaacagcatggtggccttgactaagtttatggcgacagcagttggggtaacatgtgacctggatctgatcattgtgattcaagtcagcgtcatttagggttttcgggaaacattttttgaaagggagcaacttggctggaacactccatcaattctttgccctgtgcatttttgcccttctttctgcctctcaggaatgcagagagaattcctggaggaacagcagctatcatacatccgtgatgaaagccatgggacaaaggcaattgagcaagaagacaggagctggggacattcttgacagtagtgccacctctggatgatttaccttgggacctcttattaaatgagataggacttcttcctgtttaatccactggagtggaattttctgttacagtgaatgcagtcctaattgatgatattggctaatacatattagcacctgctatgtcccagtacagtttaagcattttatctactaatgttttaaattttctcagtgaccttatgagataggccaaaggttctcagagtgtggttcctggaccagcaacatcagcatcacctggaaacttgttagaaatacaaattttagggcctggccctagacccactgaatcagaaactctaggggtgaggacctagcagtctgtttaaaaagccctccatgctattttgatgaatgccaaagttggacagctactgagatagggtattgttattatccccattttacagataaggaaacagctgaatttatgtcacttgcccaatgtcacacaactagcaagactgactccttgaagctcatcacatgtaagaactgctttagagcagtggtcttcaaactttgaaagcatatcctgttgaaaaattatgtatccacttctacatttttaagttgacatctaaaaatttcacatcataagtttaaacagttgtaaaaaatgtgatttctggtatattgtgaattatgacattttaaaatgtattccatcactcctctaaatgtattcagtggtttctaaataccatagtgatttaaatctatcatcaatttaaaaaaaaaaacaagcttttttttttaacattagatattttgcatctttttctctctttttttttttttttttgagacagactctcactgcgatgcctcttcatgggtggtggatgaagaaactgaacagggccatgatccttatctgtaatttcccggctaccacactgctttggtggtcttccctcgtctcttcctgggtagaaacaactacctggagatcccaatgttcttgtcagtgcacttttcatggactgcagtgggtaaaggaactaatatttattaagcacttactatttatcaggcagtatgtgacatacaatgtatgtgggagtgtgtgtgtgtctttcctcacaattattttatagagtaggggttagtacaatgaagatgttgtagcttagagagaggaagtggcaaaaccagaattggaaaacaagactgttgggctccaaggtccatgcacttttcccctttaaaggtcttaggtaaagagtagacccatttggataggcccaaactaacagtctatctccagagtccttgtcctaaattctttaccccactgccttctgagaggaagttcatctttttaccagggagtagccaccttcagaagaattctcctgtctatataaccaaattaatagaatcctggtaaatcaactggaatgttaactgttctgattttcaactgtttttaccttcatcattaatactgaatatggactgtaggttggataactgctgttcaaggtaaggaactctgagcagcagccttgagctaccaaggcattaaataggatttttgcttaaaaatcctatatttttgcttaaaaatattaaaaatatgactgagtatatgtatatattccccccacattccaaagataaacactgttaagcatgtaaagcacattttactgtatatatatgggtggcatatgtgtgtattgttgaatactacattgctttaggcaaaaagtgttttatttctcactggatcaaaaacaattaaggatgtcattttctcttcttcctttgagttccaataaatctacatttgttcttgttcccttgtttagaggtgcaatggaaaagaagtttgcagattgtactcctgcctggttggataaactcatttgaaaataagctcctgttttgtgcagatgcaaatttaaatgtgctatttgtaactaatcactgataaaatagagatttccaaaatatattgagaaaaagagctgcagaataatttgcaagtttcataaaatcaggaagaatgcatttaaaaactaaaaaagcttgggagagtggggacatatttttcccccattgctgcattcctagtaactagatgtgtgctgcaaaaaaaaaaaaatagtttaaggaatgaattggtagctattgttatatgtaaatgtgaaattaatatctacaaatacatatctgtatttataaattgtacttacgtagagaaacaaaaaaataaaaataattgtaattacatacttagggaatatatgcttctattaatctaaaatttaattattagc

SEQ ID NO: 466898 - DNA, 3879 bp, Homo sapiens
gagcagaaatgcgttcgccaaatatatcgactatatttcctgctcacctcaccctctcacagatgctgattttgagagcgtccccaatgaacttcccgcacacaaatcgccatctcagtgtctgtttcctagggaactgaccgatgacaaaaagcaagtgactgatgcctacggtggtctcttgaggtcaaaatcataggatttctctcccccgcaaataatggcccttacttcgtaaacacgctggctccgtaatccctattattgttttgggggtttggttctgtccagggaggaggtgagggcagatgctcaagagaggctgtccccaccgtccttttgtctcagcgaaccgcagtccgcgcccgagcgccactagctgtcctgggacgggaactgcagcggcaagtgtgtgactttcttgagcccggagccacaggcctgggaagcgccgctgagacttcagggtcgtagtgacagaggaaccacccgaggctaggcggggagagggtgcagtttccggatcccgaaggcttcgagaagagccgacctgtctggaagggtctccaagaacagagaggactctgcaaccatcactcgggagccgcgtcctttcatccttgagacagctccgtggtccaacggttccccgatccgctggccgagatctcaagcttggatgcaacttcggattcgccccaggcaggaggaaggaagccccgattggaaacgtcgcgggttcgatccccgtactggccaagtattctctgtggcttttatcaccagaatggatagtaacccagacatcgatctaaacgtgtacctgtgtgtttctccaggcttaactttgccccgagaaaacggatctgtgaatttggtgcgccctcgcttactcgacagcgaagggaaggtgaggagagtcaaaggcacatggagcattaacagttggaataaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacctgacgcaggtggacaaggtggaggagagagaattccttggcagtagcattatgaacaaatgcagggctgagaaacagcatggtggccttgactaagtttatggcgacagcagttggggtaacatgtgacctggatctgatcattgtgattcaagtcagcgtcatttagggttttcgggaaacattttttgaaagggagcaacttggctggaacactccatcaattctttgccctgtgcatttttgcccttctttctgcctctcaggaatgcagagagaattcctggaggaacagcagctatcatacatccgtgatgaaagccatgggacaaaggcaattgagcaagaagacaggagctggggacattcttgacagtagtgccacctctggatgatttaccttgggacctcttattaaatgagataggacttcttcctgtttaatccactggagtggaattttctgttacagtgaatgcagtcctaattgatgatattggctaatacatattagcacctgctatgtcccagtacagtttaagcattttatctactaatgttttaaattttctcagtgaccttatgagataggccaaaggttctcagagtgtggttcctggaccagcaacatcagcatcacctggaaacttgttagaaatacaaattttagggcctggccctagacccactgaatcagaaactctaggggtgaggacctagcagtctgtttaaaaagccctccatgctattttgatgaatgccaaagttggacagctactgagatagggtattgttattatccccattttacagataaggaaacagctgaatttatgtcacttgcccaatgtcacacaactagcaagactgactccttgaagctcatcacatgtaagaactgctttagagcagtggtcttcaaactttgaaagcatatcctgttgaaaaattatgtatccacttctacatttttaagttgacatctaaaaatttcacatcataagtttaaacagttgtaaaaaatgtgatttctggtatattgtgaattatgacattttaaaatgtattccatcactcctctaaatgtattcagtggtttctaaataccatagtgatttaaatctatcatcaatttaaaaaaaaaaacaagcttttttttttaacattagatattttgcatctttttctctctttttttttttttttttgagacagactctcactgcgatgcctcttcatgggtggtggatgaagaaactgaacagggccatgatccttatctgtaatttcccggctaccacactgctttggtggtcttccctcgtctcttcctgggtagaaacaactacctggagatcccaatgttcttgtcagtgcacttttcatggactgcagtgggtaaaggaactaatatttattaagcacttactatttatcaggcagtatgtgacatacaatgtatgtgggagtgtgtgtgtgtctttcctcacaattattttatagagtaggggttagtacaatgaagatgttgtagcttagagagaggaagtggcaaaaccagaattggaaaacaagactgttgggctccaaggtccatgcacttttcccctttaaaggtcttaggtaaagagtagacccatttggataggcccaaactaacagtctatctccagagtccttgtcctaaattctttaccccactgccttctgagaggaagttcatctttttaccagggagtagccaccttcagaagaattctcctgtctatataaccaaattaatagaatcctggtaaatcaactggaatgttaactgttctgattttcaactgtttttaccttcatcattaatactgaatatggactgtaggttggataactgctgttcaaggtaaggaactctgagcagcagccttgagctaccaaggcattaaataggatttttgcttaaaaatcctatatttttgcttaaaaatattaaaaatatgactgagtatatgtatatattccccccacattccaaagataaacactgttaagcatgtaaagcacattttactgtatatatatgggtggcatatgtgtgtattgttgaatactacattgctttaggcaaaaagtgttttatttctcactggatcaaaaacaattaaggatgtcattttctcttcttcctttgagttccaataaatctacatttgttcttgttcccttgtttagaggtgcaatggaaaagaagtttgcagattgtactcctgcctggttggataaactcatttgaaaataagctcctgttttgtgcagatgcaaatttaaatgtgctatttgtaactaatcactgataaaatagagatttccaaaatatattgagaaaaagagctgcagaataatttgcaagtttcataaaatcaggaagaatgcatttaaaaactaaaaaagcttgggagagtggggacatatttttcccccattgctgcattcctagtaactagatgtgtgctgcaaaaaaaaaaaaatagtttaaggaatgaattggtagctattgttatatgtaaatgtgaaattaatatctacaaatacatatctgtatttataaattgtacttacgtagagaaacaaaaaaataaaaataattgtaattacatacttagggaatatatgcttctattaatctaaaatttaattattagc

SEQ ID NO: 466899 - DNA, 1682 bp, Homo sapiens
gagcagaaatgcgttcgccaaatatatcgactatatttcctgctcacctcaccctctcacagatgctgattttgagagcgtccccaatgaacttcccgcacacaaatcgccatctcagtgtctgtttcctagggaactgaccgatgacaaaaagcaagtgactgatgcctacggtggtctcttgaggtcaaaatcataggatttctctcccccgcaaataatggcccttacttcgtaaacacgctggctccgtaatccctattattgttttgggggtttggttctgtccagggaggaggtgagggcagatgctcaagagaggctgtccccaccgtccttttgtctcagcgaaccgcagtccgcgcccgagcgccactagctgtcctgggacgggaactgcagcggcaagtgtgtgactttcttgagcccggagccacaggcctgggaagcgccgctgagacttcagggtcgtagtgacagaggaaccacccgaggctaggcggggagagggtgcagtttccggatcccgaaggcttcgagaagagccgacctgtctggaagggtctccaagaacagagaggactctgcaaccatcactcgggagccgcgtcctttcatccttgagacagctccgtggtccaacggttccccgatccgctggccgagatctcaagcttggatgcaacttcggattcgccccaggcaggaggaaggaagccccgattggaaacgtcgcgggttcgatccccgtactggccaagtattctctgtggcttttatcaccagaatggatagtaacccagacatcgatctaaacgtgtacctgtgtgtttctccaggcttaactttgccccgagaaaacggatctgtgaatttggtgcgccctcgcttactcgacagcgaagggaaggtgaggagagtcaaaggcacatggagcattaacagttggaataaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacctgacgcaggtgggacttggggaaatgtcgagaaacctaggtctgggacttgagttggcttccagggcacacattcttgttcagaagaaacacattgcaaaaatcgggaggtgacgggcagatgaagtgtcggcgcttcgcctcgggactccagtgcaacctatggggcttttggaaatgaggaagtcgatgactctgcagggactcctctgacccaggagcagatggcgctcgtctgggcactccccaggagaaaaggtgcatcgggaagcagcctggcttgtggatggtggacaaggtggaggagagagaattccttggcagtagcattatgaacaaatgcagggctgagaaacagcatggtggccttgactaagtttatggcgacagcagatggagtcttgctctgtcgcccaggctagagtgcagtggcgcgatctcagctcactgaaacctctgcctcccgggttcaagtgattctcctgcctccgcca

SEQ ID NO: 466900 - DNA, 1760 bp, Homo sapiens
gagcagaaatgcgttcgccaaatatatcgactatatttcctgctcacctcaccctctcacagatgctgattttgagagcgtccccaatgaacttcccgcacacaaatcgccatctcagtgtctgtttcctagggaactgaccgatgacaaaaagcaagtgactgatgcctacggtggtctcttgaggtcaaaatcataggatttctctcccccgcaaataatggcccttacttcgtaaacacgctggctccgtaatccctattattgttttgggggtttggttctgtccagggaggaggtgagggcagatgctcaagagaggctgtccccaccgtccttttgtctcagcgaaccgcagtccgcgcccgagcgccactagctgtcctgggacgggaactgcagcggcaagtgtgtgactttcttgagcccggagccacaggcctgggaagcgccgctgagacttcagggtcgtagtgacagaggaaccacccgaggctaggcggggagagggtgcagtttccggatcccgaaggcttcgagaagagccgacctgtctggaagggtctccaagaacagagaggactctgcaaccatcactcgggagccgcgtcctttcatccttgagacagctccgtggtccaacggttccccgatccgctggccgagatctcaagcttggatgcaacttcggattcgccccaggcaggaggaaggaagccccgattggaaacgtcgcgggttcgatccccgtactggccaagtattctctgtggcttttatcaccagaatggatagtaacccagacatcgatctaaacgtgtacctgtgtgtttctccaggcttaactttgccccgagaaaacggatctgtgaatttggtgcgccctcgcttactcgacagcgaagggaaggtgaggagagtcaaaggcacatggagcattaacagttggaataaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacctgacgcaggtgggacttggggaaatgtcgagaaacctaggtctgggacttgagttggcttccagggcacacattcttgttcagaagaaacacattgcaaaaatcgggaggtgacgggcagatgaagtgtcggcgcttcgcctcgggactccagtgcaacctatggggcttttggaaatgaggaagtcgatgactctgcagggactcctctgacccaggagcagatggcgctcgtctgggcactccccaggagaaaaggtgcatcgggaagcagcctggcttgtggatggtggacaaggtggaggagagagaattccttggcagtagcattatgaacaaatgcagggctgagaaacagcatggtggccttgactaagtttatggcgacagcagataaggaaacagctgaatttatgtcacttgcccaatgtcacacaactagcaagactgactccttgaagctcatcacatatggagtcttgctctgtcgcccaggctagagtgcagtggcgcgatctcagctcactgaaacctctgcctcccgggttcaagtgattctcctgcctccgcca

SEQ ID NO: 466901 - DNA, 846 bp, Homo sapiens
ttgcaatgcctgatccagctaagtccgctcccgccccgaagaagggctccaagaaggcggtgaccaaggcgcagaagaaggatggcaagaagcgtaaacgcagccgcaaggagagctactccgtatacgtttacaaggtgctgaagcaagtccaccccgacaccggcatctcctccaaagccatggggatcatgaattcctttgtcaacgatatcttcgagcgcatcgccggcgaggcttcccgcctggctcattacaacaagcgttcgaccatcacctccagggagatccagacagccgtgcgcctgctgctgcctggggaactggccaagcacgccgtgtccgagggcactaaggccgtcaccaagaaccaaaaactaagtttgcaacttaaaatgcaatcaatttggagcaacacgtccaccagtctagagctgaagagcctaaaaaaggaggggaggaagaaccatcatctaccttactgcctcctcctcctccctcagccccgccattacccgggtaaagataccaaagaggagacggaggattttcctaattcccctcccccaataaatcgggaagaagacaagagatatactacagttatgggaccctgtcttaggcaagcagcattagaaggggagctcctggcttgtcctgtgatggaagatcaacaggccaattgggtacatgagcctattactttcaacacttttaaggaaatcaggaaaagcattagagaaaatggacctgctagcccattcacaagaggattaattgaggtcatagcagataactaccatattgactccatgggactggtcagtgctagctaaaacaacttta

SEQ ID NO: 466902 - DNA, 2309 bp, Homo sapiens
tgcaaggggatagtaaagaaagcatctttgaggtcgataacagaatagtgagttgtggaaagggttattgaagataggagggtgtacaggtttggcactataggatggatgggaaggacaatttgattaacaaggtgaagatcctgaaccaacctgtaagacttgtccagtttctggaggggcagcatcagtcttcagccactaagccaagaagatctgggaaggagtcagtcagagagccttggggcagagttccaggggctctgggagtggcttttgggcaagctggacagtccgatttcgagtggggacctgcacagataggacacggcttaggaggaatcctgggctgcgggcattccttggcccagtggccagatttccggcacttgaagcaagatcctgggggaggaggtcctggaggaatgcctggccactgtggtttaggcggcggtaaagcatctaagggttgttgccaaaccagccacggactgggctgggtttttatatttgatgaaaaagagcctaaacgctaaccaatttgggagaggtcagataaagaaaaaaggagcattaatcttgactatgccttcagctccggccacctctctaaaatgaaattgttgggcaggcattgaccaacatctgtgggactatatttgtggtgtaacaaagatccaagatagccagatttctaagaaagaaatatatgggggtttggagatgtttatccagtaatggcagcaggataaggaccatatttcccatcaaagaaattgcatagaagaaaaagacaaccccagagatgatcatctccagctgaggcttcccagggaacccaaggagcataagccaaccaaaatgttggaattcctggaaaatgtggcgttcttaatagtcataaaagtactaaatatatactgcaaaatgctaggtgtgtctctgagatttaggacaacttctgaaagtactgtcattaacggagaagctggaataaaaagaaaagtcactccagagcttaagtagttcctacaagtatctcaatttatgatgcttcaaaacagctattgaaacaattttactttaacttatctaatggagtatttagacttcaaaatcctattaagttcatttttcatcctcaagaactacaaaaatatcaaaatcaaatattctagatttttcattttatttaagttttctactttctcaagggagaaagagggtataaggaataaaattaatcactctagcttttttaataaaaagtctttttggcatgaatggaattatgtgactgtataaataactaggacatgagcaagagatggagcaagaaaaagtgatattggatattggatcagaaacataaaggaagttttcaaaaattctttttcaagttacaagttggtaacatagctctgaactatcccatgaatcaacatttatcttcaagacaaaaatcaaatttatcttcagtcaaaatatggaaaggataataactcaacaaaaatgagaaagaaatgcatttaaaaacacacttcagaaaaagacagaaagaccatttcaatagccaaataaatcacctttctatgtgtcagttttcttgaagcactcagagaaaaaatgtagaacatctaaaaccaggtgacatggcaatacctccatgctcatccccaaaataagtagtaaaaacttggaaggccaagtgggaaagaaaaaagcattatcttaaagatgattattggaactgataaaaatatttttcttttgtgatcacaaaaattgagctccttgagtaattatctaagcagagaaagatagggggaaattactgtggttaattaacatgagatcttttcaaagatgattgataactagaactcttggtcttcttggttaacgactagctttgctgctgtcatcttcaggctggagatttgcctgtgtaaaaatattcctgggactggttggagcaaaagtgttgtaccttaaaatagagggcaatgaaaacagcttttaatctccttaaattaatgacaatatttagttaacataatcaaaggagactattagagttaaattggtcaatatcaatataattgtaacatatataatccaaaagaaatcagtgcatagcatgttatttttagtgttggcactttagtttataatttcattttaaatatgagttttgtacatataccaatcatcatggattaagtattcaataaatacattcggcttaattataatttttattataattttattatatttttaatggatattatctttatctcaggtgt

SEQ ID NO: 466903 - DNA, 737 bp, Homo sapiens
tatcccttcagaatcttccgatggtttagaattttgccctatgaaaataaacaaggatagtgtcgcctacacagcttctctgctttttgctcaggtggtctttcctctctgggttgtctctcctcatctaccttcattctccaaatgttctccatcaggaacacgtaccaatagccaccccattatccaagccattacagacaacagtaaggaggcttctcaaaaaattaaaagtagaactactatatcatccatcaatctcactaatggatatatatccaaaggaaatgaaattgtgcagaacattaacatatgggggaaattgtatattacacaatgcagcttccacattatgctgacaccattcctctacttgtccatttactttaagagacacttactgatgcaaaggagactgaacagtgaaggatctcactcagaatcctgtccacaatctgtccagtttacaccttaccccaaagagaggtagcctgttatacaacgttcttcacctcattctctcacttcacaatatatcttggagatcttaccaaaagcacacagagacctcctgtgttgtgattagattttcattgcataatattccattgttcgtgtgtgtgtgagtgtttagttagtctcaaattgataggtgcatgaatttttccaatcttttgttaaggcaagcagtattgaataaacttgtacataatatttttgcatgtgtataattatat

SEQ ID NO: 466904 - DNA, 1656 bp, Homo sapiens
gctagaagctggagatacagtgatgcacaaagcaaatgtattctgtgtcttcttgattatagtctagtagggaagagaaaaaggtaaccaaaaaattacaatatgatgtaatagattctgtgataggaaggtgcagggaactgtgggaagggatacagaagtgtatgattcaggaaagactatatgaggaggacctcaagcacaagtgggaattaaatggaaggcagaggaggacgagagtgtttgagacaaaagacacaggaagagccaagaatgcaaggtgggaaccttaatagtgtgttcgagaaatcacaagtagttcagactcagcttgaggaggggaccgtgaaagctgagagtgaggcttgtgtgcccccttaaggggcttgctctcctcccaagagctatggggagtcacaggattgcaggcaggggagtgatgcagtcctgtgtgtcttagatcactcaggctgaggcaagactgagacaggaagatcaatcttttgcagtgatccagatgagaaatgatgtgagcctggaccgtgagaaagacgagacagtgtatgcatagggtatagacttgagagagggatttgagatggaatcaagagttgtgttaattcattggcctatcaaacagagaagaaattggagtcaagagtgactcatggccagctgggtggcaccagtcattgagatagagaactaagagaactgatttcccaaagaaaatgagctgttagatttgatattcccaatggacatcagcaagagatgtctactaggcagtagggcacatggatgtgaagcctatgaagcagatttgggctgtagctgtagatctgggtgggggttctcagccctggggcttcaccctatcctcctccaaagccctaccctctgcctgaggccaggtccccagtccctagccccttcccccgccaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466905 - DNA, 456 bp, Homo sapiens
tctctgctccatattttttaatcccttaagcatttgatgaaacactctttagtgctatatgcattttctaacttttgttaaaaatgtgacaattgtcaaaaaatgcactaaaatgtaaatggagattgaacaagttcactttccagcttataggcaactttatacagacttgcacattttctccagctgtttagtgaaagtgaaagagaaaggggttttcggccgcgaggatgggtcagtttgttatatggcaagcagaacgcgcccatggtttcggcgtaaccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466906 - DNA, 2879 bp, Homo sapiens
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466907 - DNA, 3044 bp, Homo sapiens
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcggaaaggacccctctggttctcctgtagcctgagccctgcctggaggaccccaggcccctccctggttctgacctcctcccttctgcaattggcttcagatcctgggctgcaaacctgcagggacagatggttgcaggttggaggggcaggctgcaccccagggagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466908 - DNA, 2642 bp, Homo sapiens
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacgtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466909 - DNA, 2846 bp, Homo sapiens
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466910 - DNA, 2621 bp, Homo sapiens
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcagtcgtggaagggagaaaggtgaattcaccaatttacaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466911 - DNA, 2867 bp, Homo sapiens
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466912 - DNA, 1175 bp, Homo sapiens
  misc_feature (1)..(1): n is a, c, g, or t
nttcaggacgcatcttcggtaacatttagcacacgtcgcaatgccttcttggtctcttcagtcgtaaggccataccgaagtacctgtgatgggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466913 - DNA, 584 bp, Homo sapiens
gcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagagccagatgggccaggctcaggtagtgggtggggagggaagggaggttcaagatgacctctgaatgaattattttgttttccctcctgtcccttcccacag

SEQ ID NO: 466914 - DNA, 258 bp, Homo sapiens
tgtttgattttgtcagtaagtgcttgttgaatgactgaataaatggtggtgggggggtctcctccctcaggatcctactcccttctgtctgtgcccacagtgtctcccctcctacctgctccctccccttgctcctctgctccaggttttctccaatgagggccagttcaagttccgttttggggtccgaggacgctcacctgggcagctgcagcgccccacaggtgtggcagtggacaccaatggagacataattgt

SEQ ID NO: 466915 - DNA, 1026 bp, Homo sapiens
ctaccggaggtagcgataggctctaaagcagtggttgccagcatcagccaccaccacacggccatccgaggtcagtgccaggcactgcggaacatacagtggcacagagagatgggctcgaaaaaggacaggaaggaaccagagctgtcgaactaccaggatgcgcctgtcgccccagtcaacccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466916 - DNA, 1792 bp, Homo sapiens
  misc_feature (1755)..(1755): n is a, c, g, or t
  misc_feature (1771)..(1771): n is a, c, g, or t
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgttgttccgcagccagcagcggccgcaagtttatttccttttagttgagggtttanttttagtttggcattnggccttgtttttacaacgttg

SEQ ID NO: 466917 - DNA, 2191 bp, Homo sapiens
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcaggtatagggggacagctccaagatctatgctgatacccctgttccagagaactcccctagataccccagctgtaaaggccctctcctcctatatct

SEQ ID NO: 466918 - DNA, 2864 bp, Homo sapiens
gcgacgggcgggccccaagggtgcgtttgtattcctgtcagcccgggtctgggtcggagcgtctgtgggtgggggcacagatgattttcaaaagctgtgcctctctctgcccacgtgaggcgtgtccatgtccgtgagagcagcagggggattcttcgggctgtggctgctcacaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaa

SEQ ID NO: 466919 - DNA, 2698 bp, Homo sapiens
ggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaagcaacaagaatgaagttgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatggccgtcctcggtgcccacgtcttttatcactctatatccgtcttatctctctctactacacctatcttcacactacttttattctcaccattctctctcgatcctcctatagcttacctat

SEQ ID NO: 466920 - DNA, 3443 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466921 - DNA, 3518 bp, Homo sapiens
  misc_feature (230)..(230): n is a, c, g, or t
gggcgttgtcttcacagagctccacgcaggagatcggtgaggagctgatcaacggagtcatctactccatctccctgcgcaaggtgcagctgcaccacggaggcaacaaggggcagcgctggctcgggagctccacgcaggagatcggtgaggagctgatcaacggagtcatctactccatctccccgcgcaagtgcagctgcaccacggaggcaacaaggggcagcgcnggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466922 - DNA, 3402 bp, Homo sapiens
ggagaacaggattagtgggaagatgagacccacacacagctctgagagagtaaggcagctcaccagcactgagctacaagttgaggagccgccagggacctgcagatgcccggcaggaggaccgatccctcatggagtttacattccagcgaggagggggtgctgggagacatgcagagctgtgggcggggcttccttggaggaggggagaggtgttcgccactgaccaggggcctccttggttcttttagctggacagccaagggggcttgggccggggcaggtggccttcagatggacaggggccggctcaggagcccagcctggctcaggggagcccaggcctctgactctgctgccacccacctgtccccagtgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466923 - DNA, 3227 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466924 - DNA, 3409 bp, Homo sapiens
  misc_feature (1707)..(1708): n is a, c, g, or t
  misc_feature (1710)..(1710): n is a, c, g, or t
  misc_feature (1713)..(1713): n is a, c, g, or t
  misc_feature (1715)..(1716): n is a, c, g, or t
  misc_feature (1720)..(1721): n is a, c, g, or t
  misc_feature (1724)..(1725): n is a, c, g, or t
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggnncncancnnttgnnaanngctgtgttcttcttggtcctgagggtgttgctggctgacctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466925 - DNA, 1479 bp, Homo sapiens
tagaaggttccccatctggcagctggcctggggtgcccccacagggcagtgggatctgctgatcttaccgtctccctcagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466926 - DNA, 3355 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466927 - DNA, 2883 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgcagtgagccaagatcacatcactgcattccagcctgggtgacagaccgagactctgtctca

SEQ ID NO: 466928 - DNA, 1770 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagaggtgaggccggggcagcaaatgggg

SEQ ID NO: 466929 - DNA, 1652 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatgtgagtgtgccgggcggggctggagtagggcccgggaggagagaccttccctgagccctgg

SEQ ID NO: 466930 - DNA, 364 bp, Homo sapiens
gctttttatacaaatattcaatcagccccagccccatcccaaatcctccttcctcacaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466931 - DNA, 219 bp, Homo sapiens
cgctgggcaagctccttaagccctctgtgcttgtcttctcatcccccaaatggaaatgaaagtagccagtgtgttcatcatatatgtaaaaatctatatgtatgtatatatgtgtatatgtatgtatatatgtgtatatatatgcatgtatatgtgtgtgtatatatatgcatgtatatgtgtgtgtatatatatgcatgtatatataaagcatctatg

SEQ ID NO: 466932 - DNA, 371 bp, Homo sapiens
ggcagggaccacaggcaggagagtggcctggtacacgttttgtgggttcggggagagaggcttctctggaagccggggctgttctgtgtctttggaaaggcacaggaaaggctggcatgttgttgaacttttctcctcttgcagctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaacta

SEQ ID NO: 466933 - DNA, 1756 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggcgtgagccaccgcaccatgcagcaggcggagttctcatccgcactttccagagggggaggcaggctcaggaaggccaggccaccggcccaggaccccacactagagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatgtgagtgtgccgggcggggctggagtagggcccgggaggagagaccttccctgagccctgg

SEQ ID NO: 466934 - DNA, 3613 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggagtaagtcagaagaccagagggcgatggcagagggggcaggtccacaccactccccagccccaggttggaagcctttggccccagaaaattcaccagcagagtgtgggtagacactgtggacagggcagccctggctgcccccattgtctgcttgctgtccccagcaaccactggacctccccagtgtgtgcccttccctaggcgtgaacaggcagttcaaagctcacatcagtgaggagcaaagagaaaaggcatttttcactgggacaggttagccacgtggcccactggaagggactctttctggctaagacaagaaaacatgtgctctacaaagaatggtgacagctgtggaccaaagtgtcaagtgttaaaatccatgagtgtgtgattctaaaagcagaacaggctactaggaggccaactcagtattctagaaactgggaaagtgtcaagaaccagtgcaggctcagagtggggtatcctgggcctggagacgctgggcaagctccttaagccctctgtgcttgtcttctcatcccccaaatggaaatgaaagtagccagtgtgttcatcatatatgtaaaaatctatatgtatgtatatatgtgtatatatatgcatgtatatgtgtgtgtatatatatgcatgtatatgtgtgtgtatatatatgcatgtatatataaagcatctatgtgcaccataaaagttaactataaatactatcatcgctgttttctttccagtgagctgaacaccaccttcccaccattagcccagacagtaagcaatgactcctgtgatccctagaagttacagtctaaatcctctggcagcttcttgcaccatttcggttaggtgggcagggtaggcgggacccccatcttacagaaaaggaagactgaggcctagagaggttaaagatgacgaaaagccacacgatgtcggcaggagcacaaatcgagcccagctctggtttatagcaggctgtgggccagaggagatggtgggaaatggagccaaaaggaagtgcttgccgggtgccagggttcaaggagtacaggcctccctggaacgggcgccagagccctggggcaggcctgtcctttcctggtccttggatcccttgtcctgagtagggcaggattctgggaggtgacctggattctagaaagcctgttccaggtgggcagccagcactgcagtatggg

SEQ ID NO: 466935 - DNA, 1144 bp, Homo sapiens
gtctgtggctcaagacagtccttgtatgggctctcaagcggtaggggtatcctgcagggcccccaggagcatccctgatcacccctctgcccctccccaccagagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466936 - DNA, 3380 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgttttaaagcccaacacaaaatgccggcgtttacaccttgtaactggaaaccttct

SEQ ID NO: 466937 - DNA, 1876 bp, Homo sapiens
ggccattgggtgtccaccttccagggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466938 - DNA, 4087 bp, Homo sapiens
gggcgttgtcttcacagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactaaaaaaaaaacaaaaaaaaaaaaaaccacacaaacaaaaaacacaaaaaaaaacaaaacaaaaaaaaacacaaaaacaaaaaaaaaaccaaacaaaaaaacacacacacacaacacaacaccacaaacaaaacatgaggtaagagagaggcaagaacagcaagacacgagtcagtcaagatagggaatctcacgcaacaagatgcagacgcggcgcacacgacggtagcgcgcgagccaggacggagcagcggagggagacatctgggcgtgccacgcgcgcgtcacccagcacgcggcccacgcgacagcggcccgcgcccccgcacacactgtgccggctcgaagcagcacgcagacagaaagaaagaagagaaaacaacgagcaagaacagcaggaagccgcggcgcgacagaccgaccacgagctgcgacgcacaggaggcaacgcgcggaccacgcccacccgagcgcacgggagagcacgtggaggggcgagggagggagcacccggtccaccagacctaccggacccacaccgacgggggccagctcgacggccgggaaccgagcagcaaaaagcaacaacacggggcagagtgagctagagaagggccggcagcgggcaacacgcaaccggaggcgc

SEQ ID NO: 466939 - DNA, 3553 bp, Homo sapiens
  misc_feature (230)..(230): n is a, c, g, or t
gggcgttgtcttcacagagctccacgcaggagatcggtgaggagctgatcaacggagtcatctactccatctccctgcgcaaggtgcagctgcaccacggaggcaacaaggggcagcgctggctcgggagctccacgcaggagatcggtgaggagctgatcaacggagtcatctactccatctccccgcgcaagtgcagctgcaccacggaggcaacaaggggcagcgcnggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcgccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctcggccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctacta

SEQ ID NO: 466940 - DNA, 898 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagca

SEQ ID NO: 466941 - DNA, 286 bp, Homo sapiens
cgagctcggtaccccacacgccgaaggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggagcactactcctactctgagaatcgtgtggagtctcggcgtgtgca

SEQ ID NO: 466942 - DNA, 964 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466943 - DNA, 1075 bp, Homo sapiens
ggctcagaaccggcgcggggcctgggtcggggccgccctcgcttccggcctcccagtcgggccctgtcgctggcgttggatttgactgaccgccagcgtggtggcaacgctgaagcgtccagaatcttctgcctaacctctcgccggcatggaactggctagccgttttattaaactctgttttgcgtggacggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466944 - DNA, 1095 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaaaaaaaaaaaaaaaaaaaaaaaaaaaaaaaaaaaaaaaaaaaaaaaaaaaaaaaaagaaaaaacccattgcccggtgttttcaaaaggggggcctgggaaaaccctggggtaaccaaactaaattggcttgggggcatccccttttttgcccctaggttgatatactgagcccctccccgttcgcccatgcgtggc

SEQ ID NO: 466945 - DNA, 1072 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaaaaaaaaaaaaaaaaaaaaaaaaaaagggggcggtaaattccgggggaaaggcaccgttttgaaaggcaagggtaaaaagcagggggaaacgagggaaggctggttgaggacacggggaggacccaaacgaaaaatgggcgtgggttgtaataagaggaggagatataaagag

SEQ ID NO: 466946 - DNA, 1192 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaaaaaaaaaaaaaaaaaaaactcgagactagttctctcgtctactactccgggatatctcctttggcgcgacacggtctacagcggtcaccgcctgaggacgagtgacgctggccgcacaacgaggtatacagtaccggggaccctcgccctcagacatagaaaccggggaggggaaacctgccccgtatcccggtgagtggacatgctccagggcagagagccgcaatggcaggc

SEQ ID NO: 466947 - DNA, 831 bp, Homo sapiens
tagaggatccccgatacatacttccgacgggcatccctgtagatgtcatgatgcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466948 - DNA, 822 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaatttccgggggatcctctag

SEQ ID NO: 466949 - DNA, 1057 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggagattcagggtctcactatgttgcccaagcagtacttaaactcctgggctcaaatgaccctcccaccttggtctcccaaagtgctggaattacaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466950 - DNA, 593 bp, Homo sapiens
ctgatccgcttaaggcaggaggggccggaagggctgatagccgccatctgtgcagtgtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466951 - DNA, 902 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggagcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagca

SEQ ID NO: 466952 - DNA, 910 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggagcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466953 - DNA, 838 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagca

SEQ ID NO: 466954 - DNA, 675 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctctttttttgcatcttcaaggctggcatcaggacaaatgaccacatcacggctacactgtactgggtcttttccagccaggcctgcaacggtgaccttaatcccagctcgcctcatgacggccagtagtggt

SEQ ID NO: 466955 - DNA, 725 bp, Homo sapiens
acatctcccccaacacttaaagtcttagcagctgcatttaactcacgcatatttgtttcattctaacagtggtttctgtcaccctttgctctgcacagttttaaaaatacctttgtagggggcttctaagagcttggagtgcctagtaaatgtttttgaatggttagctacagtgttgggtttatatgctgtaatagtgaatttaattggtaagtaatcgtctttctcgtcacatagcccattaggatgtcaccttttctgtttctactttgcaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466956 - DNA, 717 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcagcctactgctctgttgctcatcgaaataggttttggaaaaaaaaaaaaaaaaaaaaaaaaaaaaaaaaaaaaaaaaaaaaaaaaaaaaaaaaagaaaaaacccattgcccggtgttttcaaaaggggggcctgggaaaaccctggggtaaccaaactaaattggcttgggggcatccccttttttgcccctaggttgatatactgagcccctccccgttcgcccatgcgtggc

SEQ ID NO: 466957 - DNA, 750 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcttcattaaatatttgtcagggccgggcgcagtggctcacgcctgtaatcccagcactttgggaggctgaggcgggcagatcacctgaggtcaggagttcaagaccagcctggccaccatggtgaaaccccatctctactaaaaatacagaaattagccaggcgtggtggcgggcgcctgtaatcccagctactcgggaggctgaggcaggagaatcgcttgaacccgggaggcggaggttgcagtgagccgagattgtgccg

SEQ ID NO: 466958 - DNA, 581 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagaggaaggagattatactacccctgctactctgcagcgtggacatccttgcatgtcactacatacagggaccatatgatgtggtggttctaccaggaggtaatctgggcgcacagaatttatctgagtctgctgctgtgaaggagatactgaaggagcaggaaaaccggaagggcctgatagccgccatctgtgcagaggtgacgtgcaggggcagcctgtgttgcagcgtcattggtgggtggggtagcctttcattcgatggtttgattccaaatagctcttc

SEQ ID NO: 466959 - DNA, 465 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagaggaccaactcatccccctcctatgaaaaaacttcttaccactcaccctagcattatttatataatatgtctccatacccattacaatttccagcattccccctcaaaccta

SEQ ID NO: 466960 - DNA, 491 bp, Homo sapiens
gcggccgcctactactactaaattcgcggccgcgtcgacaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466961 - DNA, 921 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcagggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagca

SEQ ID NO: 466962 - DNA, 896 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagca

SEQ ID NO: 466963 - DNA, 936 bp, Homo sapiens
  misc_feature (22)..(22): n is a, c, g, or t
  misc_feature (78)..(79): n is a, c, g, or t
  misc_feature (94)..(94): n is a, c, g, or t
  misc_feature (112)..(112): n is a, c, g, or t
  misc_feature (114)..(114): n is a, c, g, or t
  misc_feature (175)..(175): n is a, c, g, or t
  misc_feature (197)..(197): n is a, c, g, or t
  misc_feature (221)..(221): n is a, c, g, or t
  misc_feature (251)..(251): n is a, c, g, or t
  misc_feature (268)..(268): n is a, c, g, or t
  misc_feature (279)..(279): n is a, c, g, or t
  misc_feature (284)..(284): n is a, c, g, or t
  misc_feature (332)..(333): n is a, c, g, or t
  misc_feature (366)..(366): n is a, c, g, or t
  misc_feature (392)..(392): n is a, c, g, or t
ccctgggctaaaagggaggcangagggaatattggacgaaccggtcattccccttgtacgattgttcattgacggcgnngcgtgggatttaaanggtccaccccgtttgcangncccttggcttggaaaaatgaccccacgtaccacgtgttatgcccgttgattgttggttcantttcgtcccttgattgcccacnccgttcgaacgattgcaaaaaaanaacgacgggacccattattgattgtgggtnggttcttacccacgganggtaactcgtngggcngcaccacgaatttatattcttgacgtcgtgcgtgcttgtcgaacggannatacttgaacggacgcacggaaaaccccggaangggcgctgactaggcctgccactctngtgcacggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466964 - DNA, 968 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggagcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466965 - DNA, 862 bp, Homo sapiens
tgagtctgggcagtgtggggctgagggaggccggacggcgcgcgtgcgtgctggcgtgcgttcactttcagcctggtgtggggcttgtaaacatataacataaaaatggcttccaaaagagctctggtcatcctggctaaaggagcagaggaaatggagacggtcatccctgtagatgtcatgaggcgagctgggggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466966 - DNA, 846 bp, Homo sapiens
gcggccgcctactactactaaattcgcggccgcgtcgacagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466967 - DNA, 1095 bp, Homo sapiens
ggctcagaaccggcgcggggcctgggtcggggccgccctcgcttccggcctcccagtcgggccctgtcgctggcgttggatttgactgaccgccagcgtggtggcaacgctgaagcgtccagaatcttctgcctaacctctcgccggcatggaactggctagccgttttattaaactctgttttgcgtggacggtaaaccctccagataatctgcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466968 - DNA, 952 bp, Homo sapiens
gccgcgtcgacacggctgcgagagacgacagaagggggctggcgtgcgttcattttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466969 - DNA, 956 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagca

SEQ ID NO: 466970 - DNA, 1022 bp, Homo sapiens
tgagtctgggcagtgtggggctgagggaggccggacggcgcgcgtgcgtgctggcgtgcgttcactttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttca

SEQ ID NO: 466971 - DNA, 815 bp, Homo sapiens
gccgcgtcgacacggctgcgagagacgacagaagggggctggcgtgcgttcattttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaggggaggtttgggtcacgttgtcctacttactttggggaggttgggaggcacactacacacagattcttaccctctggggct

SEQ ID NO: 466972 - DNA, 11677 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466973 - DNA, 11375 bp, Homo sapiens
gttattggctcaccaagtttgaaagtagtgtgttgctctagaaagagatgttaaggtatgttgtacctgacttcatatttgggttccaccatttaccaggtgagagaccatggccatatccaaaatctgagaggcttccatttaattgtcacttccattgtgactattaaaagacatgatgaatttgaagttcattgtatattaacactttaattattcttcctgtttcagacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466974 - DNA, 6564 bp, Homo sapiens
  misc_feature (25)..(25): n is a, c, g, or t
cccgcgggcatggggctgtacaatnatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466975 - DNA, 12382 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgtttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataaccccaagtggtg

SEQ ID NO: 466976 - DNA, 11765 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataaaaaaggaaaatcgggttagcggggggaaagggagaggcaggaagtgtccgacagtttgtcaagggatcggcccaaggggaatggagcg

SEQ ID NO: 466977 - DNA, 11838 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatattcttaaacaaaaaaacaaacaaaacaaaaaaaaaaaacaacaacaacacaaacaacaaaaacaacaaaaaaaaacaacaaaaaatagaaagacagaaaaaccagaactcacgaaacaaaaaacacaacacacaaagaagaggggcggcgcggcgcagagaagataagtacccacctgagggagccacccccatagcgcgctcacacgcaagacggtgtgtcgacaacagagaggggcgcaacacaaagaggggaacacaaatacaaaggacagcagccggacagcggc

SEQ ID NO: 466978 - DNA, 11632 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466979 - DNA, 12565 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtaagggcccaggaacggagaaaagatggcgggtgggaggtggggcctcctgcacagtagcgatggcttgctctagcctcaaatttagggaggtgctgccctccctaataggaattccccataggaatctggttttagataatcttactgagttgtctcctatcttctgggcctgccctgctggctggccctttagctaagctacccaacaattcccagacagacaggaaagtctttggtgtttataaggatatacctgctggctttgcaatgagagctttaatattgctatactaggaatgaccatgtatgagtggcctccaccaaactggtaactgctcactggtgattctgaagccacctagaggagatcagcagtttgtaatactgagcgtaggagctgatgagatgaaagacctattggagttgtttaatgattcctccccatctcttgtggtgtgggctctccaactgtgtaatcacaagaagtcagggagtctccctagacagactgtatgccatgttcttccaccaccaaatacctttagagaatttggactctgggcttatccctctctaataccacttttctcccctccccacttcacctaagcaaggcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466980 - DNA, 11948 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466981 - DNA, 12035 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgggccagcgtgactggagcaaggaggagttgcagggagcaaaagtctaaagagctcagcagaggtccgattaccagtgactctgaaaaccaccttcaagtttgcactttagcctatgggcgagtgaggccagggtgtttaaggaggagtgacagggtcagatttttggttttggtgcctgatggccagtttgggagccagataaagggggacatactgggctgagacaagattgggagtcatcaagaagcagggagttggtttcttcagggaggggaggggctggtgggcaccatgggaacacacagatttggttatctgtcatccctcaccacaaactgatctttcttctttccttagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466982 - DNA, 2460 bp, Homo sapiens
cttggtcgtctctagaggtatcccctggtagcgctcgggttacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466983 - DNA, 2415 bp, Homo sapiens
cttggtcgtctctagaggtatcccctggtagcgctcgggttacaagaaagccaagcagacaggcaggctaggttcctccggtttaggctcagctagcagcatccaggcagctgttcggcagctggaggctgaggctgatgccattatacaaatgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466984 - DNA, 2603 bp, Homo sapiens
tagcaatcattggactcgaccacacacacacacacaacagaagaagacttgaagtctatatacaggaggctagttctgactggtcacaggtctggattgtagactgtaggaaatgtaagcatccaaggagctgttgggaaaagcttacaaaacacagtggagaaaagcagaagagttgggaaaggcatccttttgtcctggatagctacagttttccccacccaaatatgggaagcttctttgcaagctcaatgtatgagaagtggaagggccaacctctagcctgtctctaaggaaagcagagttgcacccttatgtgatttttgtctcccttttatccagtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466985 - DNA, 2479 bp, Homo sapiens
cttggtcgtctctagaggtatcccctggtagcgctcgggttacaagaaagccaagcagacaggcaggctagtgttcctcgcgtgattagagcttcagacatagcagtgatccaaggattctgatcggaagtgtgaatgctgacgttgttgcgattatacaaagtggtacgggatagctgaaagggcgcgcatactcctattcgtagcaagtgtcgtgttcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466986 - DNA, 10783 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtaggtcaggaaatcctaatcacagcacatcccagccaatctggaagatccattccaggttcaccttagaactagcactgcgtgaccttctcatagttctaaggaagcatcttgacttcttaaagctgtagcaggtgtttgtgagtgacatcacaaacaggaaaaccagaatttgcaggccatttcctagtttcacctttattaaaaaaaaaaaa

SEQ ID NO: 466987 - DNA, 1689 bp, Homo sapiens
aaggatccccaccacactgggcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466988 - DNA, 1712 bp, Homo sapiens
cgacgcatccaccccaacataaggctaggtacgaggccgggtgttactcgactttgatgtcagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466989 - DNA, 9704 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggtctgcagcatgccaggttgctaagtgctacagcctgctgtggctttggtccatgccacagag

SEQ ID NO: 466990 - DNA, 9669 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatgtcggagtctagccagtcagaggcgtctgtccggagggaggaatcacccatggatgtggaccagccatctcccagtgctcaagatactcaatccattgcctccgatggaaccccacagggggagaaggaaaaggaagaaagagaggaggaccttgcagctgtggaaggctccttggagcctcctttgtgggagggtatcagttctggttctgccagagcctcagccctggtagcagaacctcagggctgcccctctccccaaactcctcccagcaaggctgaccctttgagctcactcc

SEQ ID NO: 466991 - DNA, 8562 bp, Homo sapiens
  misc_feature (8552)..(8552): n is a, c, g, or t
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgccagaccccatccccagatcctntagagtacct

SEQ ID NO: 466992 - DNA, 8723 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgccatgtgactcagaaccacggcataattctggaaccggtgcttcctccatcaccactgccacctcaaccacatctaccaccaccaccactgccgcctccaccacgcccacaccccctactgaccctcaacctgtgcacactcttaactgtgacgcctgctgtccccgtccccttcagtgccttctctctcaagt

SEQ ID NO: 466993 - DNA, 8735 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466994 - DNA, 5440 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtg

SEQ ID NO: 466995 - DNA, 6442 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgataatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgtttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataaccccaagtggtg

SEQ ID NO: 466996 - DNA, 6084 bp, Homo sapiens
  misc_feature (6049)..(6049): n is a, c, g, or t
  misc_feature (6057)..(6057): n is a, c, g, or t
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcagccaagtacaaataggagtgacccgttaaaatccagggttttttgttttttggttacaatcttggaccctttggttacattccttttttctgtggaanatgtggantattatttaaacatttggatttggaaa

SEQ ID NO: 466997 - DNA, 1183 bp, Homo sapiens
gtgcttaggttgagcttgcatacttgatgttttcaggaccctacccaagattgggaacacaaatgtggctgagtcctggaccttgggtaactcacaatttggtgtttctatggaggtgatgtttgagatgagatgtgctagacacagtgggggctggggagacactgtcaggtaaacagcaccacaagagagcatggtgtattccagggccagcgtgactggagcaaggaggagttgcagggagcaaaagtctaaagagctcagcagaggtccgattaccagtgactctgaaaaccaccttcaagtttgcactttagcctatgggcgagtgaggccagggtgtttaaggaggagtgacagggtcagatttttggttttggtgcctgatggccagtttgggagccagataaagggggacatactgggctgagacaagattgggagtcatcaagaagcagggagttggtttcttcagggaggggaggggctggtgggcaccatgggaacacacagatttggttatctgtcatccctcaccacaaactgatctttcttctttccttagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 466998 - DNA, 1617 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgattttgttagagtatctttttcacaggtgagagagtttgaaatgggtggtgtccaggaattcccctggcatgtgtacc

SEQ ID NO: 466999 - DNA, 989 bp, Homo sapiens
  misc_feature (793)..(793): n is a, c, g, or t
  misc_feature (795)..(795): n is a, c, g, or t
  misc_feature (824)..(824): n is a, c, g, or t
  misc_feature (863)..(863): n is a, c, g, or t
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttncnctccgctaaagatttcaaatccaggggantccatgctcaatggatgaatgtagacacaaaacagcaanacttgtatgaagatgtaaagtgctgaacatatttttttcctgtttcctttccttttttttaaaaaatctgaattgtgccctgtactgcagttacttgtttgaataaaagttattatttattgcacg

SEQ ID NO: 467000 - DNA, 533 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtggtaagattcaacacagggcaaactgagtaaagatgtatatgtgcttttctggaaaatgtgtttcgttatcagagtccagtaattaccgtattcattttaattggaatccaattaagaggggaaagatgtgccacccttttgtttttgttctagactggtttgccagaaattagccaa

SEQ ID NO: 467001 - DNA, 476 bp, Homo sapiens
gttagcatgatgcctgtggcccctcattcatttgtctctccactcatccccccaccatgtcatcagtggggtttcattgcctttaccttgtatgcttttgcattaagtttgctatatgaatgcttctggacaaaagggttactttctgttggtgttttcctatttgttgattggtttgttggtttgatttgatttaaagcttggccatcataccccactcccagctatccagtcaacagtggcgcttttgcaaactgcctgatgctaagtgttgtctgggttctgaggggttatggggtgaagttttttttcagtcccatggaacaatgcaggtacatcagaaacatctcaggaatcctaccattgaaagtcccccaagcttggtacatatcccacacagccacttctgtctgtggctgctccctccaccctgccctctgcctttattctccataatcccttggcacctaggcact

SEQ ID NO: 467002 - DNA, 494 bp, Homo sapiens
aaactggttccaaaggatgagaaggcaggtacgacccagggcggaaaaagatcaggtaactctaagaaactaaaatgttagtcattacttctaagttttgttcctacgtctttataggtttattatgaaaatttttagttagttctatcatccatagtctagttttcatcctctcactaatttttagtcatttcttccataaaaacatatatacataatggtaaaatttagaaaatgtagttgaaagaattacccgtatttctgccaccaaaaaaaaaaaaaaaacattttggaagtgtctgcccgtcttttttctctgaatacatttgccagtgtcttagataaaaacatttcgtagatctctttcttcacttaatgttaggtaccatataaaggtacacgaattaactattccctgttaagtttctaatatgctatttttaaaaaatgaacatttttgtatctacttttctacaaatgtaaaattgattcct

SEQ ID NO: 467003 - DNA, 330 bp, Homo sapiens
aggcctagaattttatacagtgcctcctcctctgttctcttaatattggtattgtgaatttctgtgtaactcactcttttctcccctaacagggttgttggtacagaggaacgtattcctattcccctcatggattacatccttaatgtggtaagattcaacacagggcaaactgagtaaagatgtatatgtgcttttctggaaaatgtgtttcgttatcagagtccagtaattaccgtattcattttaattggaatccaattaagaggggaaagatgtgccacccttttgtttttgttctagactggtttgccagaaattagccaacac

SEQ ID NO: 467004 - DNA, 941 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacaggtaagagaatggctctctctcttattac

SEQ ID NO: 467005 - DNA, 1230 bp, Homo sapiens
  misc_feature (1046)..(1046): n is a, c, g, or t
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagataaggaacaggcactatgaacttttgtttagagactntaaagggctatagagaccctgctcaggctatgcacctaatgatactcacttttcatggctctccaagaccctcccagctttgacaatggcaaagataacagatactcaattccagcccaggcatctgtagttgatctctatttagctcccttggtagagatacacagattgaagagggtccagg

SEQ ID NO: 467006 - DNA, 4240 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactggtaagttccgcttgctcctggcccttggatattaagtgtgtggcctggtataaatccagaaatttatttatgaggaggtctgtaacttgaagagcctccttaggcaagtattaggacatttgctggctaattgattgtttgggtcaatttattaggtacttcagtagcttcttctggccttgccctgttgtaatccctgccagagacactgaggactcattcattctagtccttcacttcaaagagctcattttggtggggcagtaggctttacatatagttaatggtttacaaatcaagtgataattaagggttaaatggatgtatgtctcgtgtaacacagtgcgaaatagacgtcatctgtgtattcctgccaagaaatgtttgacctgtatttaattatgaggaaacaattagataaatacaaattgtgagatgttctatataagacaactggcctagactcttcaaaaatattaatgttatg

SEQ ID NO: 467007 - DNA, 5852 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467008 - DNA, 1102 bp, Homo sapiens
aagtacactccaaagacggttgtcatatacagctttggccacaatgcgtccgacaaacttgaagtagctgaggtggttggggttgcagtgggaagatggattgatggtgtaggtgactcgatcaccaggtgaggtacggaacaaggcatacatagggttaaacatctctcgagagatgatcatataccactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467009 - DNA, 8659 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgccagctcgctcctgagtgcagctcgcacctgagttagcatgctcgcccgctgagttagcagctcgcgcctgagttatgcagctcgcttctgagtttagcacgctcgctcctgttataccagctcgcccgt

SEQ ID NO: 467010 - DNA, 1157 bp, Homo sapiens
gcaggctggtacgccccggaagttagggatctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467011 - DNA, 9945 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattggtcagtactacttcctgtttccagccgagcaaaagggatagccagtcttctggaatgtctgctgaatcccctgctcccagcatatataagcccagtgttttcccatttgttccagtaaaccctggtttctgtaaatgatgacaggtgtttgacaaccaaggcacacttttctttcctgtagtaaaggaaagaaaatggtgggatatcatgcattcagacagcatgtttttatggggttttctcttgttgtggtggttgtttttgagacagtctccctctgtcgccaggctggaatgcagtggcacgatgtctgctcactgcaacctctgcctcctgggttcaagcaattctcctgtctcagctactcgggaggctgcggctggaggatcgcttgagtccaggagttctgggctgtagtgcgctatgccgatc

SEQ ID NO: 467012 - DNA, 10066 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaacccagcaggcttctcctgacattctctccggagcctattaatgccatttctcaggctgccccgaacgagaagtcttcggtggagagattcacgacgggggtaaagcggaacctaggggcacagagccactggtgagtgggcatgcaggccggcgacacacctccggccgacaatgagtaaggcaatatccgagcaggggcgtcaaagggcaccgaaaaaacgccaggacacaagccagtgtgaaacacaggggtacgagcgcgagaacaggtatgcacgaagaagacagcgacgagaagataag

SEQ ID NO: 467013 - DNA, 10221 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatccccgggaagtcccggtacgagctcaatcgtatcatgcatagcgctgctgttgaaaaacagggggcaagaag

SEQ ID NO: 467014 - DNA, 10829 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcagatcatcgatgtcaatggtgggcagtcctgatgtcg

SEQ ID NO: 467015 - DNA, 10359 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagtcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467016 - DNA, 12319 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtaagggcccaggaacggagaaaagatggcgggtgggaggtggggcctcctgcacagtagcgatggcttgctctagcctcaaatttagggaggtgctgccctccctaataggaattccccataggaatctggttttagataatcttactgagttgtctcctatcttctgggcctgccctgctggctggccctttagctaagctacccaacaattcccagacagacaggaaagtctttggtgtttataaggatatacctgctggctttgcaatgagagctttaatattgctatactaggaatgaccatgtatgagtggcctccaccaaactggtaactgctcactggtgattctgaagccacctagaggagatcagcagtttgtaatactgagcgtaggagctgatgagatgaaagacctattggagttgtttaatgattcctccccatctcttgtggtgtgggctctccaactgtgtaatcacaagaagtcagggagtctccctagacagactgtatgccatgttcttccaccaccaaatacctttagagaatttggactctgggcttatccctctctaataccacttttctcccctccccacttcacctaagcaaggcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467017 - DNA, 11739 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgggccagcgtgactggagcaaggaggagttgcagggagcaaaagtctaaagagctcagcagagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467018 - DNA, 11431 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467019 - DNA, 11429 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggttcctccggtttaggctcagctagcagcatccaggcagctgttcggcagctggaggctgaggctgatgccattatacaaatgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467020 - DNA, 11448 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatcccttccccctcgccgccgaccgagttcttccttttcagaccaaagtcgcctgcc

SEQ ID NO: 467021 - DNA, 11527 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacacagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467022 - DNA, 6557 bp, Homo sapiens
ggctctgctctgtaaccttcagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467023 - DNA, 11691 bp, Homo sapiens
ctgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagtagtacagatactattttgatgggtgctgagagaatagtaaatagtggatagtctaaattaaaagttctaaccaatgaaatataaacggaggcgatcctctagattgtagctgcagagcgtgcatattcgtattcggctgatggtatttacataccgttcgtgtgtatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467024 - DNA, 10813 bp, Homo sapiens
gaccatagaggatccccgcctgtaccctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggcgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataa

SEQ ID NO: 467025 - DNA, 450 bp, Homo sapiens
ctccactttctggtcccgtgccccagtcagcaccgcgctcagcaagtagcgtccagccagtggcgctgtgaacacgcctgtctctggatcataatagcctccatcattgagcaggactctgtcgaaggggaccgtgcctggttcagaccggggcaaactcagagcagctgaaaatgccacttggggcacaggggctgctggtgccccggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttcta

SEQ ID NO: 467026 - DNA, 473 bp, Homo sapiens
ctattgtgtgttgctaatcattgactgtagtcccaaaaaagccttgtgaaaatgttatgccctatgtaacagcagagtaacataaaataaaagtacattttataaaccaaaaaaaaaaaaaaaaaactcaaggtgaacaggaggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggctcccccgcgcgggcgccgcccaccgccatactaaacgatcgaggaataaagacacttggtttttcta

SEQ ID NO: 467027 - DNA, 3920 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacaggaggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttcta

SEQ ID NO: 467028 - DNA, 4300 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacaggaggagtggagggggcaccagcagcccctgtgccccaagtggcattttcagctgctctgagtttgccccggtctgaaccaggcacggtccccttcgacagagtcctgctcaatgatggaggctattatgatccagagacaggtagtcctgggaggggctgggttgaacggttggagaaatgggtgaggtgtgcagtgatatcttcccattcttgccttttccgacagtgtgaatcttcattctctgatttggggagaccccggctctttcttcatttattcattctcaggcagtggggagaagaagtagtcattcattcattcagcagatctttactggggcctgctcctgcccaggcactgttttaagtgctgggaatgcatagtgaacaaagcccccagttccctgccgctcacattccagtgaggtgaaaagacccagagggtccctcctcagtccaggagttctggtgcgctccccggagcttccctggcccccctgactgctatccttgtccccaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttcta

SEQ ID NO: 467029 - DNA, 4449 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacagggtgagtgcctttcatttgattctggagggagaagtgactaggggttggaggatagaggtcctcgggcagccctgggctggggatccagcaggggaagggggctggcactctgccctgagcatcccctttaacatccacccttcccactcaggagtggagggggcaccagcagcccctgtgccccaagtggcattttcagctgctctgagtttgccccggtctgaaccaggcacggtccccttcgacagagtcctgctcaatgatggaggctattatgatccagagacaggtagtcctgggaggggctgggttgaacggttggagaaatgggtgaggtgtgcagtgatatcttcccattcttgccttttccgacagtgtgaatcttcattctctgatttggggagaccccggctctttcttcatttattcattctcaggcagtggggagaagaagtagtcattcattcattcagcagatctttactggggcctgctcctgcccaggcactgttttaagtgctgggaatgcatagtgaacaaagcccccagttccctgccgctcacattccagtgaggtgaaaagacccagagggtccctcctcagtccaggagttctggtgcgctccccggagcttccctggcccccctgactgctatccttgtccccaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttcta

SEQ ID NO: 467030 - DNA, 4464 bp, Homo sapiens
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacaggaggagtggagggggcaccagcagcccctgtgccccaagtggcattttcagctgctctgagtttgccccggtctgaaccaggcacggtccccttcgacagagtcctgctcaatgatggaggctattatgatccagagacaggtagtcctgggaggggctgggttgaacggttggagaaatgggtgaggtgtgcagtgatatcttcccattcttgccttttccgacagtgtgaatcttcattctctgatttggggagaccccggctctttcttcatttattcattctcaggcagtggggagaagaagtagtcattcattcattcagcagatctttactggggcctgctcctgcccaggcactgttttaagtgctgggaatgcatagtgaacaaagcccccagttccctgccgctcacattccagtgaggtgaaaagacccagagggtccctcctcagtccaggagttctggtgcgctccccggagcttccctggcccccctgactgctatccttgtccccaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaaactaaacgaaccgttctgctacggtacggggtcgggggctgccgggcgtgcacagggcacggggcgggagagacgacggcctccggagaggaccccgggttccgcactgcgttcgccgcctccgcccggctcggggcggctcggggttggctcaggca

SEQ ID NO: 467031 - DNA, 3151 bp, Homo sapiens
  misc_feature (3099)..(3099): n is a, c, g, or t
  misc_feature (3102)..(3102): n is a, c, g, or t
  misc_feature (3105)..(3105): n is a, c, g, or t
  misc_feature (3108)..(3108): n is a, c, g, or t
  misc_feature (3113)..(3113): n is a, c, g, or t
gcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccagctcaaggtgaacaggagtgggggggccagcagccctgtgcccaagtggatttcagngcngantgnccgtntgacaggcggccctgaaagatccgtcaagaggaggaaa
